US010105437B2

(12) United States Patent
Anderson et al.

(10) Patent No.: US 10,105,437 B2
(45) Date of Patent: Oct. 23, 2018

(54) EPITOPES RELATED TO COELIAC DISEASE

(71) Applicant: BTG International Limited, London (GB)

(72) Inventors: Robert Anderson, Victoria (AU); Tim Beissbath, Heidelberg (DE); Jason Tye Din, Victoria (AU)

(73) Assignee: BTG INTERNATIONAL LIMITED, London (GB)

( * ) Notice: Subject to any disclaimer, the term of this patent is extended or adjusted under 35 U.S.C. 154(b) by 0 days.

(21) Appl. No.: 14/630,004

(22) Filed: Feb. 24, 2015

(65) Prior Publication Data

US 2016/0279233 A1 Sep. 29, 2016
US 2017/0296651 A9 Oct. 19, 2017

Related U.S. Application Data

(60) Division of application No. 13/541,864, filed on Jul. 5, 2012, now Pat. No. 9,017,690, which is a continuation of application No. 11/568,428, filed as application No. PCT/GB2005/001621 on Apr. 28, 2005, now abandoned.

(30) Foreign Application Priority Data

Apr. 28, 2004 (AU) .................................. 2004201774
Feb. 11, 2005 (AU) .................................. 2005900650

(51) Int. Cl.
| | | |
|---|---|---|
| *A61K 39/00* | (2006.01) | |
| *C07K 14/00* | (2006.01) | |
| *A61K 39/35* | (2006.01) | |
| *A23L 33/17* | (2016.01) | |
| *G01N 33/564* | (2006.01) | |
| *C12N 15/82* | (2006.01) | |
| *A23L 33/185* | (2016.01) | |
| *A23L 33/18* | (2016.01) | |
| *C07K 14/415* | (2006.01) | |

(52) U.S. Cl.
CPC .............. *A61K 39/35* (2013.01); *A23L 33/17* (2016.08); *A23L 33/18* (2016.08); *A23L 33/185* (2016.08); *A61K 39/001* (2013.01); *C07K 14/415* (2013.01); *C12N 15/8251* (2013.01); *C12N 15/8258* (2013.01); *G01N 33/564* (2013.01); *G01N 2333/415* (2013.01); *G01N 2800/06* (2013.01)

(58) Field of Classification Search
CPC ....... A61K 39/35; A61K 39/001; A23L 33/18; A23L 33/185; A23L 1/305; C12N 15/8251; C12N 15/8258; C07K 14/415; G01N 33/564
See application file for complete search history.

(56) References Cited

U.S. PATENT DOCUMENTS

| | | |
|---|---|---|
| 4,459,355 A | 7/1984 | Cello et al. |
| 4,536,475 A | 8/1985 | Anderson |
| 4,710,461 A | 12/1987 | Komano et al. |
| 4,886,753 A | 12/1989 | Marcker et al. |
| 4,943,674 A | 7/1990 | Houck et al. |
| 4,945,050 A | 7/1990 | Sanford et al. |
| 5,036,006 A | 7/1991 | Sanford et al. |
| 5,086,169 A | 2/1992 | Mascarenhas |
| 5,097,025 A | 3/1992 | Benfey et al. |
| 5,100,792 A | 3/1992 | Sanford et al. |
| 5,107,065 A | 4/1992 | Shewmaker et al. |
| 5,110,732 A | 5/1992 | Benfey et al. |
| 5,177,010 A | 1/1993 | Goldman et al. |
| 5,179,022 A | 1/1993 | Sanford et al. |
| 5,187,073 A | 2/1993 | Goldman et al. |
| 5,187,267 A | 2/1993 | Comai et al. |
| 5,202,257 A | 4/1993 | Heinemann et al. |
| 5,204,253 A | 4/1993 | Sanford et al. |
| 5,250,515 A | 10/1993 | Fuchs et al. |
| 5,356,799 A | 10/1994 | Fabijanski et al. |
| 5,371,014 A | 12/1994 | Matsuyama et al. |
| 5,405,765 A | 4/1995 | Vasil et al. |
| 5,428,146 A | 6/1995 | Logemann et al. |
| 5,459,252 A | 10/1995 | Conkling et al. |
| 5,464,763 A | 11/1995 | Schilperoort et al. |
| 5,478,744 A | 12/1995 | Sanford et al. |
| 5,484,956 A | 1/1996 | Lundquist et al. |
| 5,489,520 A | 2/1996 | Adams et al. |
| 5,495,007 A | 2/1996 | Thompson et al. |
| 5,508,468 A | 4/1996 | Lundquist et al. |
| 5,510,318 A | 4/1996 | Patel et al. |
| 5,538,877 A | 7/1996 | Lundquist et al. |
| 5,554,798 A | 9/1996 | Lundquist et al. |

(Continued)

FOREIGN PATENT DOCUMENTS

| | | |
|---|---|---|
| EP | 0242236 | 10/1987 |
| EP | 0255378 | 2/1988 |

(Continued)

OTHER PUBLICATIONS

US 5,792,925, 08/1998, de Framond (withdrawn)
Non-Final Office Action dated Aug. 27, 2014 received in copending U.S. Appl. No. 13/672,183.
Non-Final Office Action dated Oct. 2, 2014 received in copending U.S. Appl. No. 10/516,837.
Cornell et al., "In vitro mucosal digestion of synthetic gliadin-derived peptides in celiac disease," Journal of Protein Chemistry (1995) 14(5):335-339.
Notice of Allowance dated Aug. 8, 2012 received in copending U.S. Appl. No. 11/556,208.

(Continued)

*Primary Examiner* — Cherie M Stanfield
(74) *Attorney, Agent, or Firm* — Arrigo, Lee, Guttman & Mouta-Bellum, LLP

(57) ABSTRACT

The invention herein disclosed is related to epitopes useful in methods of diagnosing, treating, and preventing coeliac disease. Therapeutic compositions which comprise at least one epitope are provided.

9 Claims, 41 Drawing Sheets

Specification includes a Sequence Listing.

(56) References Cited

U.S. PATENT DOCUMENTS

| | | | |
|---|---|---|---|
| 5,565,346 A | 10/1996 | Facciotti | |
| 5,589,583 A | 12/1996 | Klee et al. | |
| 5,589,610 A | 12/1996 | De Beuckeleer et al. | |
| 5,618,988 A | 4/1997 | Hauptmann et al. | |
| 5,629,183 A | 5/1997 | Saunders et al. | |
| 5,633,363 A | 5/1997 | Colbert et al. | |
| 5,646,333 A | 7/1997 | Dobres et al. | |
| 5,670,349 A | 9/1997 | Cramer et al. | |
| 5,689,044 A | 11/1997 | Ryals et al. | |
| 5,859,328 A | 1/1999 | Nasrallah et al. | |
| 6,036,983 A | 3/2000 | Nielsen | |
| 6,232,445 B1 | 5/2001 | Rhode et al. | |
| 7,144,569 B1 | 12/2006 | Anderson et al. | |
| 7,202,216 B2 | 4/2007 | Sollid et al. | |
| 7,303,871 B2 | 12/2007 | Hausch et al. | |
| 7,307,871 B2 | 12/2007 | Liaw | |
| 8,835,603 B2 | 9/2014 | Anderson et al. | |
| 2003/0073102 A1* | 4/2003 | Kwok .............. | A61K 39/0008 435/6.12 |
| 2003/0215438 A1* | 11/2003 | Hausch .............. | A61K 31/42 424/94.63 |
| 2005/0249719 A1 | 11/2005 | Shan et al. | |
| 2005/0256054 A1 | 11/2005 | Sollid et al. | |
| 2006/0240475 A1* | 10/2006 | Khosla .............. | A61K 31/42 435/7.1 |
| 2008/0318852 A1 | 12/2008 | Anderson et al. | |

FOREIGN PATENT DOCUMENTS

| | | |
|---|---|---|
| EP | 267159 | 5/1988 |
| EP | 0369367 | 5/1990 |
| EP | 442174 | 8/1991 |
| EP | 486233 | 5/1992 |
| EP | 486234 | 5/1992 |
| EP | 0293358 | 4/1993 |
| EP | 539563 | 5/1993 |
| EP | 604662 | 7/1994 |
| EP | 672752 | 9/1995 |
| EP | 0693119 | 1/1996 |
| EP | 905236 | 3/1999 |
| EP | 0905518 | 3/1999 |
| EP | 0535330 | 2/2002 |
| WO | 9102071 | 2/1991 |
| WO | 9200377 | 1/1992 |
| WO | 9217580 | 10/1992 |
| WO | 9220809 | 11/1992 |
| WO | 9413863 | 6/1994 |
| WO | 9506128 | 3/1995 |
| WO | 9720058 | 6/1997 |
| WO | 9747745 | 12/1997 |
| WO | 9823960 | 6/1998 |
| WO | 9845460 | 10/1998 |
| WO | 9845461 | 10/1998 |
| WO | 9856811 | 12/1998 |
| WO | 9920775 | 4/1999 |
| WO | 9953075 | 10/1999 |
| WO | 9958681 | 11/1999 |
| WO | 0047814 | 8/2000 |
| WO | 0125793 | 4/2001 |
| WO | 02083722 | 10/2002 |
| WO | 03066079 | 8/2003 |
| WO | 03096979 | 11/2003 |
| WO | 03096984 | 11/2003 |
| WO | 03104273 | 12/2003 |
| WO | 04045392 | 6/2004 |
| WO | 2010060155 | 6/2010 |

OTHER PUBLICATIONS

Hiebert et al., "E2F-1:DP-1 induces p53 and overrides survival factors to trigger apoptosis," Mol Cell Biol (1995) 15(12):6864-6874.

Troncone et al., "Cytokines produced by Gliadin-Specific T Cell Clines rom the Coeliac Mucosa," Gasroenterology (1996) 110(4):A103.

Godkin et al., "Identification of Coeliac Disease-Specific T Cell Epitope from A-Gliadin," Gut (1999) 44(Suppl 1):72.

Saito "New immunotherapy for allergic diseases—Allergen-peptide immunotherapy and DNA-based vaccine," The Allergy in Practice (2003) 23(12):26-30.

Itoh "An Analysis of Allergy Research and Treatment," Immunology Frontier (2001) 11(4):57-63.

Fountain et al., "The Electronic Plant Gene Register," Plant Physicol (1999) 119:363-364.

Gutierrez, "DNA replication and cell cycle in plants: learning from geminiviruses," EMBO J. (2000) 19:792-799.

Helin et al., "Heterodimerization of the transcription factors E2F-1 and DP-1 leads to cooperative trans-activation," Genes Dev (1993) 7:1850-1861.

Helin et al., "A cDNA encoding a pRB-binding protein with properties of the transcription factor E2F," Cell (1992) 70:337-350.

Kosugi et al., "PCF1 and PCF2 specifically bind to cis elements in the rice proliferating cell nuclear antigen gene," (1997) 9:1607-1619.

Anderson et al., "Lesion volume, injury severity, and thalamic integrity following head injury," Theor Appl Genet 95:59-65.

Kohler et al., "Continuous cultures of fused cells secreting antibody of predefined specificity," Nature (1975) 256 (5517):495-497.

Hirahara "New Specific Imunotherapies for Japanese Cedar Pollinosis," The Society for Bioscience and Bioengineering Japan (2002) pp. 152-155.

Osman et al., "B Cell Epitopes of Gliadin," Clinical and Experimental Immunology (2000) 121:248-254.

Lodish et al., Chapter 27: Immunity; Molecular Cell Biology (1995) pp. 1328-1329.

Janeway et al., Chapter 3: Antigen Recognition by B-cell and T-cell Receptors; Immuno Biology, 5th Ed. (2001) pp. 114-115.

Tye-Din et al., Comprehensive, Quantitative Mapping of T-Cell Epitopes in Gluten in Celiac Disease, Sci Trans Med (2010) 2:41-51.

Skerritt "Antigenicity of Wheat Prolamins: Detailed Epitope Analysis using a Panel of Monoclonal Antibodies," (2000) Journal of Cereal Science (2000) 32:259-279.

Mazzarella "Cytokines Produced by Gliadin-Specific T Cell Clones from the Coeliac Mucosa," (1996) A1031.

Biagi et al., "A non-toxic analogue of a coeliac-activating gliadin peptide: a basis of immunomodulation?" Aliment Phramacol Ther (1999) 13:945-950.

Terreaux "Increased HLA-DQ2-affinity of a Synthetic Gliadin Peptide by Acid-Induced Deamidation of Glutamine Residues," Bioorganic and Medicinal Chemistry Letters 8 (1998) 2039-2044.

Final Office Action dated Sep. 10, 2013 received in copending U.S. Appl. No. 10/516,837.

Office Action dated Oct. 2, 2012 received in copending U.S. Appl. No. 10/516,837.

Wang et al., "ICK1, a cyclin-dependent protein kinase inhibitor from *Arabidopsis thaliana* interacts with both Cdc2a and CycD3, and its expression is induced by abscisic acid," Plant J (1998) 15:501-510.

Waterhouse et al., "Virus resistance and gene silencing: killing the messenger," Trends Plant Sci. (1999)4(11):452-457.

Whisstock et al., "Prediction of protein function from protein sequence and structure," Q Rev Biophs (2003) 36(3):307-340 Review.

Weiner et al., "Oral tolerance: cytokine milieu in the gut and modulation of tolerance by cytokines," Res Immunol (1997) 10:667-674.

Anderson "Identification of the Immunodominant T-Cell Epitope in A-Gliadin Recognized by Coeliac Disease (CD) Patients in Vivo," Australian Gastroenterology (1995) p. A165.

Gutgemann et al., "Induction of rapid T cell activation and tolerance by systemic presentation of an orally administered antigen," (1998) 8:667-673.

Van de Wal et al., "Selective deamidation by tissue transglutaminase strongly enhances gliadin-specific T cell reactivity," The Journal of Immunology (1998) 161(4):1585-1588.

Mowat et al., "Coeliac disease—a future for peptide therapy?," Lancet (2000) 356(9226):270-271.

(56) References Cited

OTHER PUBLICATIONS

Van de Wel et al., "Coeliac disease: it takes three to tango!," Gut (2000)46(5)734-737.
Vander et al., "Specificity of tissue transglutaminase explains cereal toxicity in celiac disease," Journal of Experimental Medicine (2002) 195(5):643-649.
Wieser et al., "Coeliac active peptides from gliadin: large-scale preparation and characterization," Z Lebensm Unters Forch (1992) 194(3):229-234.
Kumar et al., "Human genome search in celiac disease: mutated gliadin T-cell-like epitope in two human prograins promotes T-cell activation," Journal of Molecular Biology (2002) 319(3):579-599.
Moustakas et al., "Structure of celiac disease-associated HLA-DQ8 and non-associated HLA-DQ9 alleles in complex with two disease-specific epitopes," International Immunology (2000) 12(8):1157-1166.
Piper et al., "High selectivity of human tissue transglutaminase for Immunoactive gliadin peptides: implications for celiac sprue," Biochemistry (2002) 41(1):386-393.
Plebanski et al., "Protection from Plasmodium berghei infection by priming and boosting T cells to a single class I-restricted epitope with recombinant carriers suitable for human use," Eur J Immunol (1998) 28(12):4345-4355.
Vader et al., "The gluten response in children with celiac disease is directed toward multiple gliadin and glutenin peptides," Gastroenterology (2002) 122:1729-1737.
Arentz-Hansen "The intestinal T cell response to alpha-gliadin in adult celiac disease is focused on a single deamidated glutamine targeted by tissue transglutaminase," J Exp Med (2000) 191(4):603-612.
Anderson et al., "In vivo antigen challenge in celiac disease identifies a single transglutaminase-modified peptide as the dominant A-gliadin T-cell epitope," Nature Medicine (2000) 6(3):337-342.
Uhlig et al., "Role of tissue transglutaminase in gliadin binding to reticular extracellular matrix and relation to coeliac disease autoantibodies," Autoimmunity (1998) 28:185-195.
Okita et al., "Evolution and heterogeneity of the alpha-/beta-type and gamma-type gliadin DNA sequences," The Jounal of Biological Chemistry (1985) 260(13):8203-8213.
Godkin et al., Gastroenterology (1996) 110(4):A103.
Database SwissProt Online! ID:GDA4-Wheat ACC:P04724 (1987) Abstract.
Van de Wal et al., "Small intestinal T cells of celiac disease patients recognize a natural pepsin fragment of gliadin," Proc Natl Aced Sci USA (1998) 95:10050-10054.
O'Keefe et al., "T cell proliferation, MHC class II restriction and cytokine products of gliadin-stimulated peripheral blood mononuclear cells (PBMC)," Clin Exp Immunol (1999) 117:269-276.
Altschul "A Protein Alignment Scoring System Sensitive at All Evolutionary Distances," (1993) J Mol Evol 36:290-300.
Von Arnim et al., "Light inactivation of *Arabidopsis* photomorphogenic repressor COP1 involves a cell-specific regulation of its nucleocytoplasmic partitioning," Cell (1994) 79:1035-1045.
Ngo et al., "Computational Complexity, Protein Structure Prediction, and the Levinthal Paradox," The Protein Folding Problem and Tertiary Structure Prediction. Ed. K.Merz and S. Le Grand. Boston: Birkhauser (1994) pp. 491-495.
Skolnick et al., "From genes to protein structure and function: novel applications of computational approaches in the genomic era," Trends in Biotech (2000) 18:34-39.
Attwood et al., "The Babel of Bioinformatics," Science (2000) 290(5491):471-473.
Maiuri et al., "In vitro activities of A-gliadin-related synthetic peptides: damaging effect on the atrophic coeliac mucosa and activation of mucosal immune response in the treated coeliac mucsoa," Scand J Gastroenterol (1996)31 (3):247-253.
Moldberg et al., "Tissue transglutaminase selectively modifies gliadin peptides that are recognized by gut-derived T cells in celiac disease," Nature Med (1998) 4(6):713-717.

Mullighan et al., "High-resolution HLA-DQB1 typing using the polymerase chain reaction and sequence-specific primers," Tissue Antigens (1997) 50(6):688-692.
Olerup et al., "HLA-DQB1 and -DQA1 typing by PCR amplification with sequence-specific primers (PCR-SSP) in 2 hours," Tissue Antigens (1993) 41(3):119-137.
Ota et al., "T-cell recognition of an immunodominant myelin basic protein epitope in multiple sclerosis," Nature (1990) 346(6280):183-187.
Quarsten et al., "HLA binding and T cell recognition of a tissue transglutaminase-modified gliadin epitope," Eur J Immunol (1999) 29(8):2506-2514.
Thurau et al., "Oral tolerance in a murine model of relapsing experimental autoimmune uveoretinitis (EAU): induction of protective tolerance in primed animals," Clin Exp Immunol (1997) 109(2):370-376.
Vasil et al., "Herbicide resistant fertile transgenic wheat plants obtianed by microprojectile bombardment of regenerable embryogenic callus," Biotechnology (1992) 10:667-674.
Welner et al., "Oral tolerance: cytokine milieu in the gut and modulation of tolerance by cytokines," Res Immunol (1997) 10:667-674.
Yoshika et al., "The oral administration of low-dose antigen induces activation followed by tolerization, while high-dose antigen induces tolerance without activation," Clin Immunol Immunopathol (1997) 82:207-215.
Anderson "Identification of the Immunodominant T-Cell Epitope in A-Gliadin Recognized by Coeliac Disease (CD) Patients in Vivo," Australian Gastroenteroloty (1995) p. A165.
Dieterich et al., "Identification of tissue transglutaminase as the autoantigen of celiac disease," (1997) 3(7):797-801.
McAdam et al., "Gliadin Sperific Response by Small Intestinal T Cells," Peptide Binding to HLA Molecules and T Cells, Eighth International Symposium on Coeliac Disease (1999) p. 17.
Sjostrom et al., "Identification of a gliadin T-cell epitope in coeliac disease, general importance of gliadin deamidation for intestinal T-cell recognition," Scand J. Immunol (1998) 48(2):111-115.
Tian et al., "Antigen-based immunotherapy for autoimmune disease: from animal models to humans?," Immunology Today (1999) 20(4):190-195.
Arentz-Hansen et al., "Celiac lesion T cells recognize epitopes that cluster in regions of gliadins rich in proline residues," Gastroenterology (2002) 123(3):803-809.
Jung et al., "From combinatorial libraries to MHC ligand motifs, T-cell superagonists and antagonists," Biologicals (2001) 29(3-4):179-181.
Madsen et al., "A humanized model for multiple sclarosis using HLA-DR2 and a human T-cell receptor," Nature Genetics (1999) 29(3):343-347.
Chevalier et al., "The Electronic Plant Gene Register," Plant Physiology (1999) 119:363-364.
Office Action dated May 14, 2012 received in copending U.S. Appl. No. 11/556,208.
Final Office Action dated Jan. 6, 2012 received in copending U.S. Appl. No. 11/568,428.
Office Action dated Aug. 24, 2011 received in copending U.S. Appl. No. 11/556,208.
Advisory Action dated May 31, 2011 received in copending U.S. Appl. No. 11/556,208.
Final Office Action dated Jan. 20, 2011 received in copending U.S. Appl. No. 11/556,208.
Evavold et al., "Separation of IL-4 production from Th cell proliferation by an altered T cell receptor ligand," Science (1991)252(5010):1308-1310.
Arentz-Hansen et al., "The Molecular Baisis for Oat Intolerance in Patients with Celiac Disease," PLoS Med Oct. 2004;1(1):e1.
NCBI_BLAST search results for instant SEQ ID No. 1787 (last accessed Aug. 16, 2010).
Non-Final Office Action dated Aug. 18, 2010 received in copending U.S. Appl. No. 11/566,428.
Notice of Allowance dated Sep. 22, 2010 received in copending U.S. Appl. No. 11/556,218.

(56) References Cited

OTHER PUBLICATIONS

Non-Final Office Action dated May 18, 2010 received in copending U.S. Appl. No. 11/556,208.
Notice of Allowance dated Aug. 2, 2006 received in copending U.S. Appl. No. 10/089,700
Final Office Action dated Apr. 18, 2006 received in copending U.S. Appl. No. 10/089,700.
Non-final Office Action dated Aug. 26, 2005 received in copending U.S. Appl. No. 10/089,700.
Non-final Office Actioon dated Dec. 29, 2004 received in copending U.S. Appl. No. 10/089,700.
Non-final Office Action dated Jan. 6, 2010 received in copending U.S. Appl. No. 11/556,218.
Ach et al., "RRB1 and RRB2 encode maize retinoblastoma-related proteins that interact with a plant D-type cyclin and geminivirus replication protein," Mol Cell Biol (1997) 17:5077-5086.
Albani et al., "DcE2F, a functional plant E2F-like transcriptional activator from Daucus caroia," J Biol Chem (2000) 275 (25):19258-19267.
Bandara et al., "Functional synergy between DP-1 and E2F-1 in the cell cycle-regulating transcription factor DRTF1/E2F," EMBO J (1993) 12:4317-8324.
Borge et al., "Occupational physical activity, metabolic syndrome and risk of death from all causes and cardiovascular disease in the HUNT 2 cohort study," Plant Cell (1997) 9:75-83.
Breeden et al., "Regulation of the yeast HO gene," Cold Spring Harbor Symp. Quant. Biol. (1985) 50:643-650.
Breeden, "Start-specific transcription in yeast," Curr Topics Microbiol. Immunol. (1996) 208:95-127.
De Jager et al., "Retinoblastoma proteins in plants," Plant Mol Biol (1999) 41(3):295-299.
De la Luna et al., "Nuclear accumulation of the E2F heterodimer regulated by subunit composition and alternative splicing of a nuclear localization signal," J Cell sci (1996) 109(PT10):2443-2452.
Denecke et al., "Plant and mammalian sorting signals for protein retention in the endoplasmic reticulum contain a conserved epitope," EMBO J (1992) 11(6):2345-2355.
Doonan et al., "Conserved and novel regulators of the plant cell cycle," Curr Opin Cell Biol (1997) 9(6):824-830.
Dynlacht et al., "DNA-binding and trans-activation properties of Drosophila E2F and DP proteins," Proc Natl Acad Sci USA (1994) 91(14):6359-6363.
Dyson, "The regulation of E2F by pRB-family proteins," Gene Dev (1998) 12:2245-2262.
Fields et al., "A novel genetic system to detect protein-protein interactions," Nature (1989) 340:245-246.
Fuerst et al., "Modulation of cyclin transcript levels in cultured cellos of Arabidopsis thaliana," Plant Physiol (1996) 112:1023-1033.
Gillaspy G.E. et al., GenEmbl Accession No. U39059, Nov. 18, 1996.
Gillespie "The magic and challenge of DNA probes as diagnostic reagents," Vet Microbiol (1990).
Girling et al., "A new component of transcription factor DRTF1/E2F," Nature (1993) 362-83-87.
Grafi et al., "A maize cDNA encoding a member of the retinoblastoma protein family; involvement in endoreduplication," Proc Natl Acad Sci USA (1996) 93:8962-8967.
Gutierrez, "The retinoblastoma pathway in plant cell cycle and development," Curr Opin Plant Biol (1998) 1:492-497.
Helin et al., "Inhibition of E2F-1 transactivation by direct binding of the retinoblastoma protein," Mol Cell Biol (1993) 13:6501-6508.
Huntley et al., "The plant cell cycle," Curr Opin Plant Biol (1999) 2:440-446.
Huntley et al., "The maize retinoblastoma protein homologue ZmRb-1 is regulated during leaf development and displays conserved interactions with G1/S regulators and plant cyclin D (CycD) proteins," (1998) 37:155-169.
Kozak "At least six nucleotides preceding the AUG initiator codon enhance translation in mammalian cells," J Mol Biol (1987) 196:947-950.
Krek et al., "Binding to DNA and retinoblastoma gene product promoted by complex formation of different E2F family members," Science (1993) 262:1557-1560.
Lipman et al., "Rapid and sensitive protein similarity searches," Science (1985) 227(4693):1435-1441.
Lowndes et al., "Control of DNA synthesis genes in fission yeast by the cell-cycle gene cdc10+," (1992) 355:449-453.
Lui et al., "The Arabidopsis Cdc2a-interacting protein ICK2 is structurally related to ICK1 and is a potent inhibitor of cyclin-dependent kinase activity in vitro," Plant J (2000) 21:379-386.
Magyar et al., "Characterization of two distinct DP-related genes from Arabidopsis thaliana," FEBS Lett (2000) 486(1);79-87.
Mariconti et al., "The E2F family of transcription factors from Arabidopsis thaliana. Novel and conserved components of the retinoblastoma/E2F pathway in plants," J Biol Chem (2002) 277(12);9911-9919. EPub Jan. 10, 2002.
Martinez-Balbas et al., "Regulation of E2F1 activity by acetylation.," EMBO J (2000) 19:662-671.
Marzio et al., "E2F family members are differentially regulated by reversible acetylation," J Biol Chem (2000) 275:10887-10892.
Mironov et al., "Cyclin-dependent kinases and cell division in plants—the nexus ," Plant Cell (1999) 11:509-521.
Nakagami et al., "Tobacco retinoblastoma-related protein phosphorylated by a distinct cyclin-dependent kinase complex with Cdc2/cyclin D in vitro," Plant J (1999) 18:243-252.
Nevins "E2F: a link between the Rb tumor suppressor protein and viral oncoproteins," Science (1992) 258:424-429.
Ouelete et al., "Complexes containing the retinoblastoma gene product recognize different DNA motifs related to the E2F binding site," Oncogene (1992) 7:1075-1081.
Ramirez-Parra et al., "Characterization of wheat DP, a heterodimerization partner of the plant E2F transcription factor which stimulates E2F-DNA binding," FEBS Lett (2000) 486:73-78.
Ramirez-Parra et al., "The cloning of plant E2F, a retinoblastoma-binding protein, reveals unique and conserved features with animal G(1)/S regulators," Nucl Acids Res (1999) 27:3527-3533.
Sandler et al., "Inhibition of gene expression in transformed plants by antisense RNA," Plant Molecular Biolog (1988) 11(3):301-310.
Sanford et al., "Optimizing the biolistic process for different biological applications," Methods Enzymol (1993) 217:483-509.
Sardet et al., "E2F-4 and E2F-5, two members of the E2F family, are expressed in the early phases of the cell cycle," Proc Natl Acad Sci USA (1995) 92(6):2403-2407.
Sawado et al., "dE2F2, a novel E2F-family transcription factor in Drosophila melanogaster," Biochem Biophys Res Coimmum (1998) 251(2):409-415.
Scott et al., "Model system for plant cell biology: GFP imaging in living onion epidermal cells," Biotechniques (1999) 26:1125-1132.
Sekine et al., "Isolation and characterization of the E2F-like gene in plants," FEBS Lett (1999) 460:117-122.
Shoemaker et al., EMBL Acc No. AI939068 (1999).
Slansky et al., "Introduction to the E2F family: protein structure and gene regulation," Curr Topics Microbiol Immunol (1996) 208:1-30.
Smith et al., "Comparison of Biosequences," Adv. Mathematics (1981)2:482-489.
Suarez-Lopez et al., "DNA replication of wheat dwarf geminivirus vectors: effect of origin structure and size," Virology (1997) 227(2):389-399.
Tao et al., "Subunit composition determines E2F DNA-binding site specificity," Mol Cell Biol (1997) 17:6994-7007.
Umada et al., "A distinct cyclin-dependent kinase-activating kinase of Arabidopsis thaliana," Proc Natl Acad Sci USA (1998) 95:5021-5026
Van der Krol et al., "Inhibition of flower pigmentation by antisense CHS gene: promoter and minimal sequence requirements for the antisense effect," Plant Mol Biol (1990) 14(4):457-466.
Varagona et al., "Nuclear localization signal(s) required for nuclear targeting of the maize regulatory protein Opaque-2," Plant Cell (1992) 4:1213-1227.

(56) References Cited

OTHER PUBLICATIONS

Waterhouse et al., "Virus resistance and gene silencing: killing the messenger," (1999) 4(11):452-457.
Whisstock et al., "Prediction of protein function from prortein sequence and structure," Q Rev Biophs (2003) 36(3):307-340 Review.
Xie et al., "GRAB proteins, novel members of the NAC domain family, isolated by their interaction with a geminivirus protein," Plant Mol Biol (1999) 39:647-656.
Xie et al., "Identification and analysis of a retinoblastoma binding motif in the replication protein of a plant DNA virus: requirement for efficient viral DNA replication," EMBO J (1995) 14:4073-4082.
Xie et al., "Plant cells contain a novel member of the retinoblastoma family of growth regulatory proteins," EMBO J (1996) 15:4900-4908.
Zheng et al., "Structural basis of DNA recognition by the heterodimeric cell cycle transcription factor E2F-DP," Genes Dev (1999) 13:666-674.
Fleckenstein "Gliadin T cell epitope selection by tissue transglutaminase in celiac disease. Role of enzyme specificity and pH influence on the transamidation versus deamidation process," J Biol Chem (2002) 277(37):34109-34116.
Fraser et al., "Coeliac disease: in vivo toxicity of the putative immunodominant epitope," Gut (2003) 52(12);1698-1702.
Lundin et al., "Oats induced villous altrophy in coeliac disease," Gut (2003) 52(11);1649-1652.
Van de Wal "Glutenin is involved in the gluten-driven mucosal T cell response," Eur J Immunol (1999) 29(1):3133-3139.
Ohtani et al., "Functional properties of a *Drosophila* homolog of the E2F1 gene," Mol Cell Biol (1994) 14(3):1603-1612.
Riou-Khamlichi et al., "Cytokinin activation of *Arabidopsis* cell division through a D-type cyclin," (1999) 283:1541-1544.
Van Arnim et al., "Cloning vectors for the expression of green fluorescent protein fusion proteins in transgenic plants," Gene (1997) 22(1):35-43.

Wu et al., "In vivo association of E2F and DP family proteins," Mol Cell biol (1995) 15(5):2536-2546.
Anderson et al., "Lesion volume, injury severity, and thalamic integrity following head injury," Theor Appl Genet (1997) 95:59-65.
Ormondroyd et al., "A new member of the DP family, DP-3, with distinct protein products suggests a regulatory role for alternative splicing in the cell cycle transcription factor DRTF1/E2F," Oncogene (1995) 11(8):1437-1446.
Altschul et al,. "Basic local alignment search tool," J Mol Biol (1990) 215(3):403-410.
Bunce et al., "Phototyping: comprehensive DNA typing for HLA-A, B, C, DRB1, DRB3, DRB4, DRB5 & DOB1 by PCR with 144 primer mixes utilizing sequence-specific primers (PCR-SSP)," Tissue Antigens (1995) 46(5);355-367.
Dalta et al., "Plant promoters for transgene expression," Biotechnology Am Rev (1997) 3:269-296.
Devereux et al., "A comprehensive set of sequence analysis programs for the VAX," Nucleic Acids Research (1964) 12(1 Pt 1):385-395.
Greenberg et al., "Transglutaminases: multifunctional cross-linking enzymes that stabilize tissues," FASEB (1991) 5(15):3071-3077.
Henikoff "Amino acid substitution matrices from protein blocks," Proc Natl Acad Sci Usa (1992) 89(22):10915-10919.
Karlin et al., "Applications and statistics for multiple high-scoring segments in molecular sequences," Proc Natl Acad USA (1993) 90(12):5873-5887.
Krioka "Prospects for chemiluminescent and bioluminescent immunoassay and nucleic acid assays in food testing and the pharmaceutical industry," J Biolumin Chemilumin (1998) 13(4):189-193.
Lalvani et al., "Rapid effector function in CD8+ memory T cells," J Exp Med (1997) 186(6):859-865.
Mantzaris et al., "In vivo toxicity of a synthetic dodecapeptide from A gliadin in patients with coeliac disease," Gastroenterol (1991) 36(4):392-398.

\* cited by examiner

| Alpha/beta gliadins (n=53) | Gamma gliadins (n=53) | LMW glutenins (n=77) | HMW glutenins (n=55) | Hordeins (n=59) | Secalins (n=14) | Avenins (n=20) |
|---|---|---|---|---|---|---|
| S07361 | AAA34272 | AAB35353 | A03353 | A24095.1 | A23277 | S29209 |
| P18573 | S07398 | AAB48474 | A24266 | A25677 | AAB37403 | S29208 |
| P04728 | PS0094 | AAB48475 | A30843 | AAA32942 | AAB37404 | S29207 |
| P04727 | P21292 | AAB48476 | AAA62315 | AAA32943 | AAB37405 | S06455 |
| P04726 | P08453 | AAB48477 | AAB02788 | AAA32944 | AAB37406 | P80356 |
| P04725 | P08079 | AAB48478 | AAB23624 | AAA32955 | AAB37407 | P27919 |
| P04724 | P06659 | AAB48479 | AAB23625 | AAA32967 | AAB58403 | P14812 |
| P04723 | P04730 | BAA22613 | AAB23626 | AAA92333 | AAG35598 | JQ1048 |
| P04722 | P04729 | BAA22614 | AAB23627 | AAB28161 | CAA26449 | JQ1047 |
| P04721 | JS0402 | BAA23162 | AAB23628 | AAB71678 | S18235 | JQ1046 |
| P02863 | JA0153 | BAB78737 | AAD32223 | AAB71679 | S18236 | JG0015 |
| EEWTA | EEWTG | BAB78738 | AAF23506 | B24095 | S70327 | B36433 |
| E22364 | CAC94871 | BAB78739 | AAF23507 | B25677 | S70328 | AAB32025 |
| D22364 | CAC94870 | BAB78740 | B30843 | BAA11642 | S70329 | AAB23365 |
| CAB76964 | CAC94869 | BAB78741 | CAA26847 | CAA25509 | | AAA32716 |
| CAB76963 | CAC94868 | BAB78742 | CAA27052 | CAA25912 | | AAA32715 |
| CAB76962 | CAC11089 | BAB78743 | CAA31395 | CAA25913 | | AAA32714 |
| CAB76961 | CAC11088 | BAB78744 | CAA31396 | CAA25914 | | AAA32713 |
| CAB76960 | CAC11087 | BAB78745 | CAA32115 | CAA26889 | | 1502200A |
| CAB76959 | CAC11080 | BAB78746 | CAA43331 | CAA31861 | | 1411172A |
| CAB76958 | CAC11079 | BAB78747 | CAA43361 | CAA37729 | | |
| CAB76957 | CAC11078 | BAB78748 | CAA59340 | CAA42642 | | |
| CAB76956 | CAC11065 | BAB78749 | CAC40684 | CAA48209 | | |
| CAB76955 | CAC11064 | BAB78750 | CAC40685 | CAA51204 | | |
| CAB76954 | CAC11057 | BAB78751 | CAC40686 | CAA59104 | | |
| CAA35238 | CAC11056 | BAB78752 | CAC40687 | CAA60681 | | |
| CAA26385 | CAC11055 | BAB78753 | CAC83002 | P02864 | | |
| CAA26384 | CAB75404 | BAB78754 | CAC83003 | P06470 | | |
| CAA26383 | BAA11251 | BAB78755 | CAC83018 | P06471 | | |
| CAA10257 | AAN32705 | BAB78756 | CAC84118 | P06472 | | |
| C22364 | AAK84880 | BAB78757 | CAC84119 | P17990 | | |
| BAA12318 | AAK84780 | BAB78758 | CAC84120 | P17991 | | |
| B22364 | AAK84779 | BAB78759 | CAC84121 | P17992 | | |
| AAN32704 | AAK84778 | BAB78760 | CAC84122 | P80198 | | |
| AAB23109 | AAK84777 | BAB78761 | EEWTHW | S07189 | | |
| AAB23108 | AAK84776 | BAB78762 | JC2099 | S07365 | | |
| AAA96525 | AAK84775 | BAB78763 | JC4966 | S07975 | | |
| AAA96524 | AAK84774 | BAB78764 | JN0689 | S07976 | | |
| AAA96523 | AAK84773 | CAA30570 | JN0690 | S08312 | | |
| AAA96522 | AAK84772 | CAA31685 | P02861 | S18350 | | |
| AAA96276 | AAF42989 | CAA59313 | P02862 | S20519 | | |
| AAA34283 | AAD30556 | CAA59338 | P08488 | S52390.1 | | |
| AAA34282 | AAD30440 | CAA59339 | P08489 | T04369 | | |
| AAA34281 | AAB31090 | CAA59340 | P10387 | T04473 | | |
| AAA34280 | AAA34289 | CAA76890 | P10388 | T04474 | | |
| AAA34279 | AAA34288 | EEWT1 | S02262 | T05718 | | |
| AAA34278 | AAA34287 | P10385 | S04832 | T05737 | | |
| AAA34277 | AAA34286 | P10386 | S15720 | T06211 | | |
| AAA34276 | AAA34285 | P16315 | S18733 | 1103203A | | |

FIG. 2A

| AAA17741 | AAA34274 | S01992 | S29176 | 1103203B | | |
|---|---|---|---|---|---|---|
| A27319 | 1802407A | S04325 | S29177 | 1103203C | | |
| A22364 | 1507333A | S57645 | S29178 | 1210226A | | |
| 1307187B | 1209306A | S57654 | S29179 | 1307151A | | |
| | | | | | | |
| | Omega gliadins (n=2) | S57655 | AAN78346 | 1307151B | | |
| | A59156 | S57656 | AAO74630 | 1604464A | | |
| | AAG17702 | T05910 | | A24095.2 | | |
| | | T05923 | | AAP31051 | | |
| | | T06505.1 | | CAA48209.2 | | |
| | | T06505.2 | | S52390.2 | | |
| | | T06506 | | | | |
| | | T06508 | | | | |
| | | T06980 | | | | |
| | | T06981 | | | | |
| | | T06982 | | | | |
| | | AAP44992 | | | | |
| | | AAP44991 | | | | |
| | | AAP44989 | | | | |
| | | AAO53259 | | | | |
| | | CAD58622 | | | | |
| | | CAD58619 | | | | |
| | | CAD58621 | | | | |
| | | A03353 | | | | |
| | | AAO53264 | | | | |
| | | AAO53265 | | | | |
| | | AAO53266 | | | | |
| | | AAO53267 | | | | |
| | | CAA76890 | | | | |
| TOTAL: | All gliadins | | | | | |
| 20mers | 721 | 645 | 786 | 416 | 155 | 199 |
| 12mers | 4465 | 3945 | 4799 | 2672 | 957 | 1279 |
| 9mers | 3739 | 3164 | 3630 | 2413 | 811 | 1207 |

FIG. 2B

M-Step:

$$\frac{dQ(\theta,\theta^{(c)})}{dp_j^{(c)}}=0 \quad \to \quad p_j^{(c+1)}=\frac{\sum_i \xi_{ij}^{(c)}}{n}$$

$$\frac{dQ(\theta,\theta^{(c)})}{d\alpha_i^{(c)}}=0 \quad \to \quad \alpha_i^{(c+1)}=\frac{\sum_j[\xi_{ij}^{(c)}y_{i,j}+(1-\xi_{ij}^{(c)})y_{i,j}]}{\sum_j[\lambda_j^{(c)}\xi_{ij}^{(c)}+\lambda_0^{(c)}(1-\xi_{ij}^{(c)})]}$$

$$\frac{dQ(\theta,\theta^{(c)})}{d\lambda_j^{(c)}}=0 \quad \to \quad \lambda_j^{(c+1)}=\frac{\sum_i \xi_{ij}^{(c)}y_{i,j}}{\sum_i \alpha_i^{(c)}\xi_{ij}^{(c)}}$$

$$\frac{dQ(\theta,\theta^{(c)})}{d\lambda_0^{(c)}}=0 \quad \to \quad \lambda_0^{(c+1)}=\frac{\sum_{i,j}(1-\xi_{ij}^{(c)})y_{i,j}}{\sum_{i,j}\alpha_i^{(c)}(1-\xi_{ij}^{(c)})}$$

E-Step:

$$\xi_{ij}^{(c+1)}=E(z_{ij}|y_{i,j})=pr(z_{ij}=1|y_{i,j})=\frac{p_j^{(c)}pr(y_{i,j}|\alpha_i,\lambda_j^{(c)})}{p_j^{(c)}pr(y_{i,j}|\alpha_i,\lambda_j^{(c)})+(1-p_j^{(c)})pr(y_{i,j}|\alpha_i,\lambda_0^{(c)})}$$

Compute:

$$Q(\theta,\theta^{(c)})=\sum_{ij}\{\xi_{ij}^{(c)}\log p_j+(1-\xi_{ij}^{(c)})\log(1-p_j)+y_{i,j}\xi_{ij}^{(c)}\log(\alpha_i\lambda_j)$$
$$+y_{i,j}(1-\xi_{ij}^{(c)})\log(\alpha_i\lambda_0)-\xi_{ij}^{(c)}\alpha_i\lambda_j-(1-\xi_{ij}^{(c)})\alpha_i\lambda_0\}$$

FIG. 3A

Patient: i = 1 ... 29
Peptide: j = 1 ... 652
Plate: m = 1 ... 7
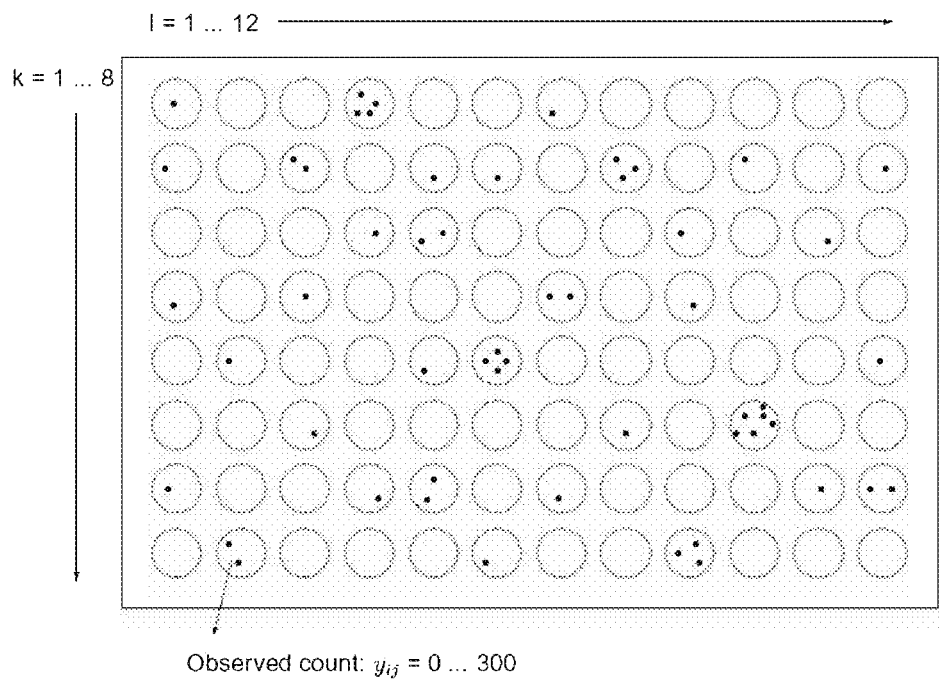
Observed count: $y_{ij} = 0 \ldots 300$
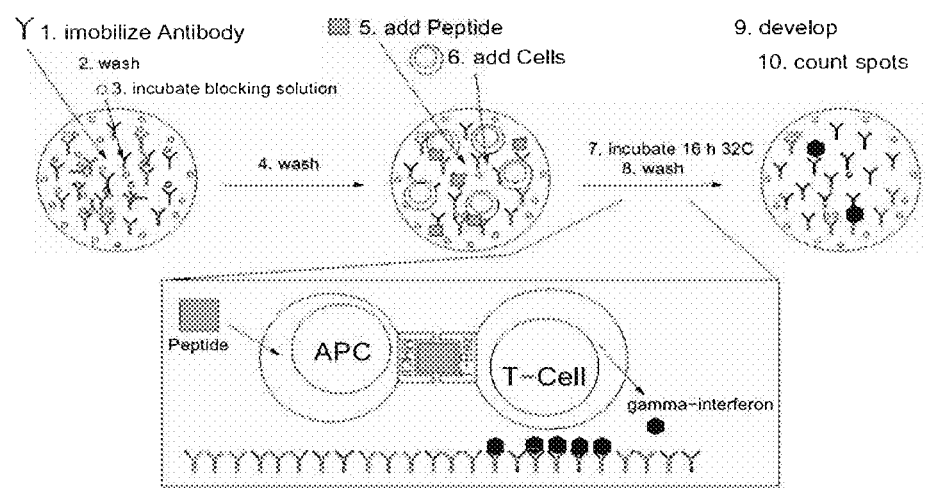
FIG. 3B

| Group | Consensus | SEQ ID NO: | Sequence | SEQ ID NO: |
|---|---|---|---|---|
| 1 | gEIpFpEpE | 1 | gqlpypqpelpypqpg | 200 |
|   |   |   | gqlpypqpqlpypqpg | 201 |
| 2 | EIpFpEpEI | 2 | ylqlqpfpqpqlpypqpqlp | 202 |
|   |   |   | pqpfppqlpypqpqlpypqp | 203 |
|   |   |   | pymqlqpfpqpqlpypqpql | 204 |
|   |   |   | qlqpfpqpqlpypqpql | 205 |
|   |   |   | gqlpypqpelpypqpg | 206 |
|   |   |   | gqlpypqpqlpypqpg | 207 |
|   |   |   | pqpfppqlpypqpqlpypqp | 208 |
|   |   |   | mqlqpfpqpqlpypqpqlpy | 209 |
|   |   |   | qlqpfpqpelpypqpql | 210 |
|   |   |   | pqlpypqpqlpypqpqlpyp | 211 |
|   |   |   | pqlpypqpqlpypqpqpfrp | 212 |
|   |   |   | lqpfpqpelpypqpelpypf | 213 |
|   |   |   | lqlqpfpqpqlpypqpqlpy | 214 |
|   |   |   | pqpfppqlpypqpqlpypqp | 215 |
| 3 | EEpFpFEpE | 3 | qpfpqpqqpfpwqpqqpfpq | 216 |
|   |   |   | pqqpqqpfpqpqqpfpwqpq | 217 |
|   |   |   | qpfpqpqqpfpwqpqqpfpq | 218 |
|   |   |   | qpfpqpqqpfpwqpqqpfpq | 219 |
| 5 | FpEpEEpIp | 4 | qqpfpqqpqqpfpqpqqpip | 220 |
|   |   |   | pqqpqqpfpqpqqpipvqpq | 221 |
|   |   |   | pqqpqqpfpqpqqpipvqpq | 222 |
|   |   |   | gqqpfpqpeqpipvqg | 223 |
|   |   |   | gqqpfpqpqqpipvqg | 224 |
|   |   |   | pqqpqqpfpqpqqpipvqpq | 225 |
| 6 | FpEpEEpFp | 5 | qpfpqpqqpfpwqpqqpfpq | 226 |
|   |   |   | pqqpqqpfpqpqqpfpwqpq | 227 |
|   |   |   | pqqpqqpqqpfpqpqqpfpw | 228 |
|   |   |   | qpfpqpqqpfpwqpqqpfpq | 229 |
|   |   |   | gqqpfpqpeqpfpwqg | 230 |
|   |   |   | gqqpfpqpqqpfpwqg | 231 |
|   |   |   | pqqpqqpqqpfpqpqqpfpw | 232 |
|   |   |   | qpfpqpqqpfpwqpqqpfpq | 233 |
|   |   |   | qpqqpfpqpeqpfpwqp | 234 |
|   |   |   | qpeqpfpqpeqpfpwqp | 235 |
|   |   |   | qpqqpfpqpqqpfpwqp | 236 |
|   |   |   | qpeqpfpqpqqpfpwqp | 237 |
| 7 | EpEIpFpEp | 6 | ylqlqpfpqpqlpypqpqlp | 238 |
|   |   |   | pqpfppqlpypqpqlpypqp | 239 |
|   |   |   | pymqlqpfpqpqlpypqpql | 240 |
|   |   |   | qlqpfpqpqlpypqpql | 241 |
|   |   |   | gqlpypqpelpypqpg | 242 |
|   |   |   | glqpfpqpelpypqpg | 243 |
|   |   |   | lqlqpfpqpqlpypqpqpfr | 244 |
|   |   |   | qlqpfpqpelpypqpqp | 245 |

FIG. 5A

|   |         |    |                                                           |     |
|---|---------|----|-----------------------------------------------------------|-----|
|   |         |    | gqlpypqpqlpypqpg                                          | 246 |
|   |         |    | pqpfppqlpypqpqlpypqp                                      | 247 |
|   |         |    | lqlqpfpqpqlpypqpqpfr                                      | 248 |
|   |         |    | lqlqpfpqpelpypqpelpypqpelpypqpqpf                         | 249 |
|   |         |    | mqlqpfpqpqlpypqpqlpy                                      | 250 |
|   |         |    | glqpfpqpelpfpqpg                                          | 251 |
|   |         |    | qlqpfpqpelpypqpgl                                         | 252 |
|   |         |    | pqlpypqpqlpypqpqlpyp                                      | 253 |
|   |         |    | qlqpfpqpqlpypqpqp                                         | 254 |
|   |         |    | glqpfpqpqlpypqpg                                          | 255 |
|   |         |    | pqlpypqpqlpypqpqpfrp                                      | 256 |
|   |         |    | lqpfpqpelpypqpelpypf                                      | 257 |
|   |         |    | lqlqpfpqpqlpypqpqlpy                                      | 258 |
|   |         |    | glqpfpqpqlpfpqpg                                          | 259 |
|   |         |    | pqpfppqlpypqpqlpypqp                                      | 260 |
|   |         |    | ypqpqlpypqpqpfrpqqsy                                      | 261 |
|   |         |    | gsgqpelpypqpgsg                                           | 262 |
|   |         |    | lqlqpfpqpqlpypqpqlpypqpqlpypqpqpf                         | 263 |
| 8 | EEpFpEpEI | 7 | qqpqqpfpqpqlpfpqqseq                                    | 264 |
|   |         |    | fpqqpqqpfpqpqlpfpqqs                                      | 265 |
| 9 | pEEpFSEEg | 8 | gqqpfpqpeqpfsqqg                                        | 266 |
|   |         |    | gqqpfpqpqqpfsqqg                                          | 267 |
| 10| gFpEpEIpF | 9 | gsgfpqpelpypgsg                                         | 268 |
| 11| pEEEpEEpF | 10 | qpqlpfpqqpqqqpqqpfpq                                   | 269 |
|   |         |    | gqqpqqqpeqpfpqqg                                          | 270 |
|   |         |    | gqqpqqqpqqpfpqqg                                          | 271 |
| 12| IEEpEEpFp | 11 | lqqpqqpfpqpqqqlpqpqq                                    | 272 |
|   |         |    | lqqpqqpfpqpqqqlpqpqq                                      | 273 |
|   |         |    | qpqqpfpqlqqpqqpfpqpq                                      | 274 |
|   |         |    | pfpqlqqpqqpfpqpqqqlp                                      | 275 |
|   |         |    | gfpqlqqpeqpfpqqg                                          | 276 |
|   |         |    | gfpqlqqpqqpfpqqg                                          | 277 |
| 13| pEpEpFIpE | 12 | lqpfpqpqpflpqlpypqpq                                    | 278 |
|   |         |    | lqlqpfpqpqpflpqlpypq                                      | 279 |
| 14| EEISpcmdI | 13 | lqqilqqqltpcmdvvlqqh                                    | 280 |
|   |         |    | ilqqilqqqltpcmdvvlqq                                      | 281 |
| 15| FEEEpFpEE | 14 | qspqqsfsyqqqpfpqqpyp                                    | 282 |
|   |         |    | yqqqpfpqqpypqqpypsqq                                      | 283 |
|   |         |    | pqqsfsyqqqpfpqqpypqq                                      | 284 |
| 16| EpFpEpEIp | 15 | ylqlqpfpqpqlpypqpqlp                                    | 285 |
|   |         |    | pymqlqpfpqpqlpypqpql                                      | 286 |
|   |         |    | qlqpfpqpqlpypqpql                                         | 287 |
|   |         |    | glqpfpqpelpypqpg                                          | 288 |
|   |         |    | lqlqpfpqpqlpypqpqpfr                                      | 289 |
|   |         |    | qlqpfpqpelpypqpqp                                         | 290 |
|   |         |    | lqlqpfpqpqlpypqpqpfr                                      | 291 |
|   |         |    | lqlqpfpqpelpypqpelpypqpelpypqpqpf                         | 292 |
|   |         |    | mqlqpfpqpqlpypqpqlpy                                      | 293 |
|   |         |    | glqpfpqpelpfpqpg                                          | 294 |

FIG. 5B

|  |  |  | | |
|---|---|---|---|---|
|  |  |  | qlqpfpqpelpypqpql | 295 |
|  |  |  | qlqpfpqpqlpypqpqp | 296 |
|  |  |  | glqpfpqpqlpypqpg | 297 |
|  |  |  | lqpfpqpelpypqpelpypf | 298 |
|  |  |  | qqpqqpfpqpqlpfpqqseq | 299 |
|  |  |  | lqlqpfpqpqlpypqpqlpy | 300 |
|  |  |  | fpqqpqqpfpqpqlpfpqqs | 301 |
|  |  |  | glqpfpqpqlpfpqpg | 302 |
|  |  |  | glqpfpqpelpylqpg | 303 |
|  |  |  | pylqlqpfpqpqlpysqpqp | 304 |
|  |  |  | glqpfpqpelpysqpg | 305 |
|  |  |  | lqlqpfpqpqlpylqpqpfr | 306 |
|  |  |  | lqlqpfpqpqlpylqpqpfr | 307 |
|  |  |  | lqlqpfpqpqlpysqpqpfr | 308 |
|  |  |  | gsgqpfpqpelpgsg | 309 |
|  |  |  | lqlqpfpqpqlpypqpqlpypqpqlpypqpqpf | 310 |
|  |  |  | glqpfpqpqlpysqpg | 311 |
|  |  |  | qpfpqpqlpysqpqqfrpqq | 312 |
|  |  |  | lqlqpfpqpqlpysqpqqfr | 313 |
|  |  |  | glqpfpqpqlpylqpg | 314 |
|  |  |  | qfpsqlpylqlqpfpqpqlp | 315 |
|  |  |  | pfpsqqpymqlqpfpqpqlp | 316 |
|  |  |  | pfpsqlpylqlqpfpqpqlp | 317 |
|  |  |  | pfpsqqpylqlqpfpqpqlp | 318 |
|  |  |  | pfpsqqpylqlqpfpqpqlp | 319 |
| 17 | pEEpEEEFp | 16 | pqqpfpqqpqqqfpqpqqpq | 320 |
|  |  |  | gqpfpqqpeqefpqpg | 321 |
|  |  |  | qqpqqpfpqqpqqqfpqpqq | 322 |
|  |  |  | gqpfpqqpeqqfpqpg | 323 |
|  |  |  | gfpqqpeqefpqpqqg | 324 |
|  |  |  | pqqpfpqqpqqqfpqpqqpq | 325 |
|  |  |  | gfpqqpqqefpqpqqg | 326 |
|  |  |  | gqpfpqqpqqqfpqpg | 327 |
|  |  |  | qqpqqpfpqqpqqqfpqpqq | 328 |
|  |  |  | pqqpqqpfpqqpqqqfpqpq | 329 |
|  |  |  | gfpqqpqqqfpqpqqg | 330 |
| 18 | pFSEEEEpI | 17 | gqppfsqqeqpvlpqg | 331 |
|  |  |  | lqqspfsqqqqpvlpqqqpv | 332 |
|  |  |  | pfsqqqppfsqqqqpvlpq | 333 |
|  |  |  | qqqpilsqqppfsqqqqpv | 334 |
|  |  |  | qppfsqqqqpvlpqqspfsq | 335 |
|  |  |  | qqqvlpqqppfsqqqqpvll | 336 |
|  |  |  | qqqpilsqqppfsqqqqpvl | 337 |
|  |  |  | qqqppfsqqqqpilpqqppf | 338 |
|  |  |  | pfsqqqppfsqqqqpilpqq | 339 |
|  |  |  | qqqpilpqlpfsqqqqpvlp | 340 |
|  |  |  | qqppfsqqqqpvlppqqspf | 341 |
|  |  |  | gqppfsqqqqpvlpqg | 342 |
|  |  |  | qspfsqqqqpvlpqqqpvii | 343 |
|  |  |  | qppfsqqqqpvlpqqspfsq | 344 |
|  |  |  | qqqppfsqqqqpvipqqpsf | 345 |

FIG. 5C

| | | | | |
|---|---|---|---|---|
| | | | lppfsqqlppfsqqqqpvlp | 346 |
| | | | qqqqppfsqqqqpvlpqqsp | 347 |
| | | | sqqqpilsqqppfsqqqqpv | 348 |
| | | | pfsqqqqpvllqqqipfvhp | 349 |
| 19 | pEEpSpIEp | 18 | ftqpqqptpiqpqqpfpqqp | 350 |
| | | | pftqpqqptpiqpqqpfpqq | 351 |
| | | | fpeqsqqpftqpqqptpiqp | 352 |
| 20 | EpEEpIpIE | 19 | pqpqqpfpqpqqpipvqpq | 353 |
| | | | pqpqqpfpqpqqpipvqpq | 354 |
| | | | gqqpfpqpeqpipvqg | 355 |
| | | | gqqpfpqpqqpipvqg | 356 |
| | | | pqpqqpfpqpqqpipvqpq | 357 |
| | | | pqpqqpipvqpqqsfpqqsq | 358 |
| | | | qpqqpipvqpqqsfpqqsqq | 359 |
| 21 | EpEEpEIpF | 20 | qqpfpqpqqpqlpfpqqpqg | 360 |
| | | | qpqqpqqpfpqpqqpqlpfp | 361 |
| | | | qqpqqpfpqpqqpqlpfpqq | 362 |
| | | | qqpqqpfpqpqqpqlpfpqq | 363 |
| | | | pqpqqpqlpfpqqpqqpfpq | 364 |
| | | | pqqpfpqpqqpqlpfpqqpq | 365 |
| | | | gqqpfpqpeqpqlpfg | 366 |
| | | | qqpfpqpqqpqlpfpqqpqq | 367 |
| | | | gqqpfpqpqqpqlpfg | 368 |
| | | | gfpqpqqpelpfpqqg | 369 |
| | | | gfpqpqqpqlpfpqqg | 370 |
| 22 | EpEIpFpEg | 21 | gsgpqpelpypqgsg | 371 |
| 23 | FpEpEIpFg | 22 | gsgpfpqpelpygsg | 372 |
| 24 | pEEpFcEEg | 23 | gqqpfpqpeqpfcqqg | 373 |
| | | | gqqpfpqpqqpfcqqg | 374 |
| 25 | FpEpEEEFp | 24 | gffpqpeqefpqpqqg | 375 |
| | | | gqqpfpqpeqefpqpg | 376 |
| | | | sqqpqqpfpqpqqqfpqpqq | 377 |
| | | | gqqpfpqpeqqfpqpg | 378 |
| | | | sqqpqqpfpqpqqqfpqpqq | 379 |
| | | | qpfpqpqqqfpqpqqpqqsf | 380 |
| | | | gffpqpqqefpqpqqg | 381 |
| | | | sqqpqqpfpqpqqqfpqpqq | 382 |
| | | | gffpqpqqqfpqpqqg | 383 |
| | | | gqqpfpqpqqqfpqpg | 384 |
| 26 | gEpSpIEpE | 25 | gqptpiqpeqpfpqqg | 385 |
| | | | gqptpiqpqqpfpqqg | 386 |
| 27 | FIpEIpFpE | 26 | lqpfpqpqqpflpqlpypqpq | 387 |
| | | | flpqlpypqpqsfppqqpyp | 388 |
| | | | gqpqpflpelpypqpg | 389 |
| | | | pqpflpqlpypqpqsfppqq | 390 |
| | | | pqpflpqlpypqpqsfppqq | 391 |
| | | | gqpqpflpqlpypqpg | 392 |
| | | | lqlqpfpqpqpflpqlpypq | 393 |
| 28 | FIEEEcSRI | 27 | svlqqlnpckvflqqqcshv | 394 |
| | | | kvflqqqcshvamsqrlarp | 395 |
| 29 | pFpEpEEpF | 28 | qpfpqpqqpfpwqpqqpfpq | 396 |

FIG. 5D

|    |            |    |                             |     |
|----|------------|----|-----------------------------|-----|
|    |            |    | pqpqqpfpqpqqpfpwqpq         | 397 |
|    |            |    | pqqpqpqqpfpqpqqpfpw         | 398 |
|    |            |    | qpfpqpqqpfpwqpqqpfpq        | 399 |
|    |            |    | gqqpfpqpeqpfpwqg            | 400 |
|    |            |    | gqqpfpqpqqpfpwqg            | 401 |
|    |            |    | pqqpqpqqpfpqpqqpfpw         | 402 |
|    |            |    | qpfpqpqqpfpwqpqqpfpq        | 403 |
|    |            |    | qpqqpfpqpeqpfpwqp           | 404 |
|    |            |    | qpeqpfpqpeqpfpwqp           | 405 |
|    |            |    | gqqpfpqpeqpfsqgg            | 406 |
|    |            |    | gqqpfpqpeqpfcqgg            | 407 |
|    |            |    | gqqpfpqpqqpfsqgg            | 408 |
|    |            |    | gqvqwpqqqpfpqpqqpfce        | 409 |
|    |            |    | pqqqqpfpqpqqpfsqqpqq        | 410 |
|    |            |    | wpqqqpfpqpqqpfcqqpqq        | 411 |
|    |            |    | psgqvqwpqqqpfpqpqqpf        | 412 |
|    |            |    | gqqpfpqpqqpfcqgg            | 413 |
|    |            |    | pqqqpfpqpqqpfceqpqrt        | 414 |
|    |            |    | qpqqpfpqpqqpfpwqp           | 415 |
|    |            |    | qpeqpfpqpqqpfpwqp           | 416 |
|    |            |    | qqqpfpqpqqpfcqqpqrti        | 417 |
|    |            |    | qqqpfpqpqqpfsqqpqqi         | 418 |
|    |            |    | qqqpfpqpqqpfceqpqrti        | 419 |
| 30 | FIEpEEpFp  | 29 | qqflqpqqpfpqqpqqpypq        | 420 |
|    |            |    | gqqqfiqpeqpfpqqg            | 421 |
|    |            |    | pqqqfiqpqqpfpqqpqqty        | 422 |
|    |            |    | gqqqfiqpqqpfpqqg            | 423 |
|    |            |    | qqqfiqpqqpfpqqpqqtyp        | 424 |
|    |            |    | fsqpqqpqqqfiqpqqpfpq        | 425 |
|    |            |    | pqqqfiqpqqpfpqqpqqty        | 426 |
|    |            |    | pqqpflqpqqpfpqqpqqpf        | 427 |
|    |            |    | pqqqflqpqqpfpqqpqpy         | 428 |
|    |            |    | pqqqflqpqqpfpqqpqqpy        | 429 |
| 31 | pEEEEIaRg  | 30 | gqqpqqqqlahgtflqphki        | 430 |
|    |            |    | qqpqqqqlahgtflqphqia        | 431 |
| 32 | EpEEpFpEp  | 31 | pqpqqpfpqpqqpfpwqpq         | 432 |
|    |            |    | pqpqpqqpfpqpqqpfpw          | 433 |
|    |            |    | qqpfpqpqpqqpfpqpqqpip       | 434 |
|    |            |    | pqpqqpfpqpqqpipvqpq         | 435 |
|    |            |    | pqpqqpfpqpqqpipvqpq         | 436 |
|    |            |    | pqpqpqqpfpqpqqpfpw          | 437 |
|    |            |    | qpqpqpfpqpqlpfpqqseq        | 438 |
|    |            |    | qpqpfpqpeqpfpwqp            | 439 |
|    |            |    | lqpqqpfpqpqqqlpqpqq         | 440 |
|    |            |    | qpeqpfpqpeqpfpwqp           | 441 |
|    |            |    | fpqqqpfpqpqlpfpqqe          | 442 |
|    |            |    | pqpqqpfpqpqqpipvqpq         | 443 |
|    |            |    | plqpqqpfpqqpqqpfpqpq        | 444 |
|    |            |    | sqpqqpfpqpqqqfpqpqq         | 445 |
|    |            |    | sqpqqpfpqpqqqfpqpqq         | 446 |
|    |            |    | pqqpfpqpqqpqqpfpqpqq        | 447 |

FIG. 5E

| | | | | | |
|---|---|---|---|---|---|
| | | | qlpfpqqpqqpfpqpqqpqq | 448 |
| | | | hqpqqqfpqtqqpqqpfpqp | 449 |
| | | | pqtqqpqqpfpqpqqtfpqq | 450 |
| | | | qpqqpqqpfpqpqqpqlpfp | 451 |
| | | | pqqpfpqpqqpqqpfpqpq | 452 |
| | | | qqpqqpfpqpqqpqlpfpqq | 453 |
| | | | sqqpqqpfpqpqqpqqsfpq | 454 |
| | | | qqqqpfpqpqqpqqpfpqpq | 455 |
| | | | qqpqqpfpqpqqpqlpfpqq | 456 |
| | | | pqqpqqpfpqpqqaqlpfpq | 457 |
| | | | lqqpqqpfpqpqqqlpqpqq | 458 |
| | | | qpqqpfpqsqqpqqpfpqpq | 459 |
| | | | qpqqpfpqlqqpqqpfpqpq | 460 |
| | | | qpqqpfpqpqqpfpwqp | 461 |
| | | | skqpqqpfpqpqqpqqsfpq | 462 |
| | | | sqqpqqpfpqpqqqfpqpqq | 463 |
| | | | qpeqpfpqpqqpfpwqp | 464 |
| | | | pfpqlqqpqqpfpqpqqqlp | 465 |
| | | | qskqpqqpfpqpqqpqqsfp | 466 |
| | | | fplqpqqpfpqqpqqpfpqp | 467 |
| | | | qqpqqqfpqpqqpqqpfpqp | 468 |
| | | | qpqqpfpqsqqpqqpfpqpq | 469 |
| | | | qpqqpfpqskqpqqpfpqpq | 470 |
| | | | plqpqqpfpqqpqqpfpqpq | 471 |
| | | | qqfpqtqqpqqpfpqpqqtf | 472 |
| | | | qqpqqpfpqskqpqqpfpqp | 473 |
| 33 | pFpIEpEEp | 32 | pqqpqqpfplqpqqpfpqqp | 474 |
| | | | gqpfplqpeqpfpqqg | 475 |
| | | | pqqpqqpfplqpqqpfpqqp | 476 |
| | | | gqpfplqpqqpfpqqg | 477 |
| | | | pqqlqqpfplqpqqpfpqqp | 478 |
| | | | pqqpqqpfplqpqqpfpqqp | 479 |
| | | | seqiipqqlqqpfplqpqqp | 480 |
| 34 | EpEEaFpEp | 33 | gqtfphqpeqafpqpg | 481 |
| | | | qtfphqpqqafpqpqqtfph | 482 |
| | | | gqtfphqpqqafpqpg | 483 |
| | | | pqqtfphqpqqafpqpqqtf | 484 |
| 35 | pEFpSEIpF | 34 | ppqqpypqpqfpsqlpylql | 485 |
| | | | qqpypqpqfpsqlpylqlqp | 486 |
| 36 | pFpEpEEEI | 35 | lqqpqqpfpqpqqqlpqpqq | 487 |
| | | | gqqpfpqpeqqlpqpg | 488 |
| | | | lqqpqqpfpqpqqqlpqpqq | 489 |
| | | | pfpqlqqpqqpfpqpqqqlp | 490 |
| | | | gqqpfpqpqqqlpqpg | 491 |
| | | | qpfpqpqqqlpqpqqpqqsf | 492 |
| 37 | ppEIpFpEp | 36 | pqpfppqlpypqpqlpypqp | 493 |
| | | | pqpfppqlpypqpqlpypqp | 494 |
| | | | qpfppqlpypqpqpfrpqqp | 495 |
| | | | pqpfppqlpypqpqlpypqp | 496 |
| | | | pqpfppqlpypqpqpfrpqq | 497 |
| | | | pqpfppqlpypqpppfspqq | 498 |

FIG. 5F

| | | | | |
|---|---|---|---|---|
| | | | pqpfppqlpypqpqsfppqq | 499 |
| | | | gqpqpfppelpypqpg | 500 |
| | | | gqpqpfppqlpypqpg | 501 |
| | | | pfpqpqpfppqlpypqpppf | 502 |
| | | | gsgppelpypqpgsg | 503 |
| | | | pfpqpqpfppqlpypqpqsf | 504 |
| | | | pqpfppqlpypqpppfspqq | 505 |
| 38 | mEIEpFpEp | 37 | pymqlqpfpqpqlpypqpql | 506 |
| | | | mqlqpfpqpqlpypqpqlpy | 507 |
| | | | mqlqpfpqpqpfppqlpypq | 508 |
| | | | pfpsqqpymqlqpfpqpqpf | 509 |
| | | | pfpsqqpymqlqpfpqpqlp | 510 |
| | | | pfpsqqpymqlqpfpqpqpf | 511 |
| 39 | EESScRImE | 38 | pqrlarsqmwqqsschvmqq | 512 |
| | | | qglarsqmlqqsschvmqqq | 513 |
| | | | pqrlarsqmwqqsschvmqq | 514 |
| | | | rlarsqmlqqsschvmqqqc | 515 |
| | | | rpqmwqqsschvmqqccqq | 516 |
| | | | mwqqsschvmqqccqqlqq | 517 |
| | | | sqmlqqsschvmqqccqql | 518 |
| | | | qqsschvmqqccqqlqqip | 519 |
| | | | qqsschvmqqccqqlqqip | 520 |
| | | | rlarsqmwqqsschvmqqqc | 521 |
| | | | arsqmlqqsschvmqqqccq | 522 |
| 40 | EEFSEpEEE | 39 | gqqqfsqpeqefpqpg | 523 |
| | | | gqqqfsqpqqqfpqpg | 524 |
| | | | gqqqfsqpeqqfpqpg | 525 |
| | | | sqqpqqqfsqpqqqfpqpqq | 526 |
| | | | sqqpqqqfsqpqqqfpqpqq | 527 |
| | | | qqfsqpeqefpqpqq | 528 |
| | | | qsqqpqqqfsqpqqqfpqpq | 529 |
| | | | qpqqqfsqpqqqfpqpqqpq | 530 |
| 41 | pEEEFpEpE | 40 | gffpqpeqefpqpqq | 531 |
| | | | sqqpqqqfpqpqqqfpqpqq | 532 |
| | | | sqqpqqqfpqpqqqfpqpqq | 533 |
| | | | pqqpfpqqpqqqfpqpqpq | 534 |
| | | | pqqqfpqpqqpqqpfpqpq | 535 |
| | | | qpfpqpqqqfpqpqpqqsf | 536 |
| | | | qqpqqpfpqqpqqqfpqpqq | 537 |
| | | | gffpqpqqefpqpqqq | 538 |
| | | | sqqpqqqfpqpqqqfpqpqq | 539 |
| | | | gffpqpqqqfpqpqqq | 540 |
| | | | qqpqqqfpqpqpqqpfpqp | 541 |
| | | | gfpqqpeqefpqpqq | 542 |
| | | | pqqpfpqqpqqqfpqpqpq | 543 |
| | | | gffsqpqqefpqpqq | 544 |
| | | | pqpqqqfpqpqqpqqsfpqq | 545 |
| | | | gfpqqpqqefpqpqq | 546 |
| | | | sqqpqqqfsqpqqqfpqpqq | 547 |
| | | | sqqpqqqfsqpqqqfpqpqq | 548 |
| | | | qqfsqpeqefpqpqq | 549 |

FIG. 5G

| | | | | |
|---|---|---|---|---|
| | | | qsqqpqqqfsqpqqqfpqpq | 550 |
| | | | pqqqfpqpqqpqqpfpqqpq | 551 |
| | | | qpqqqfsqpqqqfpqpqqpq | 552 |
| | | | qqpqqpfpqqpqqqfpqpqq | 553 |
| | | | pqqpqqpfpqqpqqqfpqpq | 554 |
| | | | gffsqpqqqfpqpqqpqqg | 555 |
| | | | tfphqpqqqfpqpqqpqqpf | 556 |
| | | | qtfphqpqqqfpqpqqpqqq | 557 |
| | | | gfpqqpqqqfpqpqqpqqg | 558 |
| | | | sqpqqqfpqpqqpqqqsfpqq | 559 |
| | | | qtcphqpqqqfpqpqqpqqp | 560 |
| 42 | pIpEIEpRn | 41 | pvpqlqpknpsqqqpqeqvp | 561 |
| | | | avrvpvpqlqpknpsqqqpq | 562 |
| 43 | SScISgIER | 42 | metscisglerpwqqqplpp | 563 |
| 44 | FEEEpIppE | 43 | pwqqqplppqqsfsqqppfs | 564 |
| | | | pwqqqplppqqsfsqqppfs | 565 |
| | | | erpwqeqplppqhtlfpqqq | 566 |
| | | | etrcipglerpwqqqplppq | 567 |
| | | | shipglerpwqqqplppqqt | 568 |
| | | | mrcipglerpwqqqplppqq | 569 |
| | | | scisglerpwqqqplppqqs | 570 |
| | | | pwqqqplppqqtlfpqqqpf | 571 |
| | | | erpwqqqplppqqsfsqqpp | 572 |
| | | | scisglerpwqqqplppqqs | 573 |
| | | | rpwqqqplppqqtfpqqppf | 574 |
| | | | pwqeqplppqhtlfpqqqpf | 575 |
| | | | ekpwqqqplppqqqppcsqq | 576 |
| | | | pwqqqplppqqsfsqqppfs | 577 |
| | | | etscipglerpwqeqplppq | 578 |
| 45 | EpIpEEpSF | 44 | sqqppfsqqqqplpqqpsf | 579 |
| | | | qplpqqpsfsqqqppfsqqq | 580 |
| | | | qqqqqplpqqpsfsqqqppf | 581 |
| | | | ppfsqqqqplpqqpsfsqq | 582 |
| | | | qplpqqpsfsqqqppfsqqq | 583 |
| | | | sqqppfsqqqqplpqqpsf | 584 |
| | | | gqqqqplpeqpsfspg | 585 |
| | | | qqqqqplpqqpsfsqqqppf | 586 |
| | | | gqqqqplpqqpsfspg | 587 |
| 46 | IIFSSIIEE | 45 | qqsryeairaivystilqeq | 588 |
| | | | aivystilqeqqqvqgsiqt | 589 |
| 47 | EpIISEEpp | 46 | qqqpilsqqppfsqqqpvl | 590 |
| | | | fsqqqppfsqqqpilsqqpp | 591 |
| | | | fsqqqppfsqqqpilsqqpp | 592 |
| | | | qqqpilsqqppfsqqqpvl | 593 |
| | | | qqqppfsqqqpilsqqppfs | 594 |
| | | | sqqqpilsqqppfsqqqpv | 595 |
| | | | qqqppfsqqqpilsqqppfs | 596 |
| 48 | EgIEIIRpI | 47 | vmqqeqqqgiqilrplfqlv | 597 |
| | | | qeqqqgiqilrplfqlvqgq | 598 |
| 49 | pFSSIIagI | 48 | csiikapfssvvagiggqyr | 599 |
| | | | csiikapfssvvagiggq | 600 |

FIG. 5H

| 50 | FcSSSIapI | 49 | yippycsttiapvgifgtn | 601 |
| | | | vyippycsttiapvgifgtn | 602 |
| 51 | RIamSERIa | 50 | qqcshvamsqrlarsqmwqq | 603 |
| | | | kvflqqqcshvamsqrlarp | 604 |
| | | | qcshvamsqrlarpqmwqqs | 605 |
| 52 | EpESFppEE | 51 | flpqlpypqpqsfppqqpyp | 606 |
| | | | pqpflpqlpypqpqsfppqq | 607 |
| | | | pqpflpqlpypqpqsfppqq | 608 |
| | | | pqpfppqlpypqpqsfppqq | 609 |
| | | | gqpqsfppeqpypqqg | 610 |
| | | | lpqlpypqpqsfppqqpypq | 611 |
| | | | gqpqsfppqqpypqqg | 612 |
| 53 | ¹siilqEqqq | 52 | rydaicaitysiilqeqqqg | 613 |
| | | | airaiiysiilqeqqqgfvq | 614 |
| | | | iraivysiilqeqqqgfvqp | 615 |
| | | | iiysiilqeqqqgqgsvesq | 616 |
| | | | airaiiysiilqeqqqvqgs | 617 |
| | | | aiiysiilqeqqqgfvqpqq | 618 |
| | | | ryeairaivysiilqeqqqv | 619 |
| | | | iraitysiilqeqqqgfvqa | 620 |
| | | | vysiilqqqqqqqqqqqgs | 621 |
| | | | aiiysiilqeqqqvqgsiqs | 622 |
| | | | siraivysiilqqqqqqqq | 623 |
| | | | aiiysiilqeqqqvqgsiqs | 624 |
| | | | aiifsiilqeqqqgfvqpqq | 625 |
| | | | siilqeqqqgqgsvesqeqq | 626 |
| | | | rhesiraiiysiilqqqqqq | 627 |
| | | | ysiilqeqqqgfvqpqqqqp | 628 |
| | | | airaiiysiilqeqqqvqgs | 629 |
| | | | yeairaiiysiilqeqqqgf | 630 |
| 54 | ESEEpEEpF | 53 | hqpqqfpqtqqpqqpfpqp | 631 |
| | | | pqtqqpqqpfpqpqgtfpqq | 632 |
| | | | qqpfpqtqqpqqpfpqqpqq | 633 |
| | | | qtqqpqqpfpqqpqqpfpqt | 634 |
| | | | qpqqpfpqsqqpqqpfpqpq | 635 |
| | | | gfpqtqqpeqpfpqqg | 636 |
| | | | gfpqsqqpeqpfpqqg | 637 |
| | | | pqqpqqpfpqtqqpqqpfpq | 638 |
| | | | qqpfpqtqqpqqpfpqlqqp | 639 |
| | | | qpqqpfpqsqqpqqpfpqpq | 640 |
| | | | qpqqpfpqtqqpqqpfpqqp | 641 |
| | | | pqtqqpqqpfpqsqqpqqpf | 642 |
| | | | qqfpqtqqpqqpfpqpqgtf | 643 |
| | | | gqqpfpqsqqpqqpfg | 644 |
| | | | qqpfpqtqqpqqpfpqqpqq | 645 |
| | | | gfpqsqqpqqpfpqqg | 646 |
| | | | qqpfpqtqqpqqpfpqskqp | 647 |
| | | | qqpfpqtqqpqqpfpqsqqp | 648 |
| | | | gfpqtqqpqqpfpqqg | 649 |
| | | | gqqpfpqseqpqqpfg | 650 |

¹ Inserted sequence

FIG. 5I

| | | | | |
|---|---|---|---|---|
| | | | gqqpfpqtqqpqqpfg | 651 |
| | | | gqqpfpqteqpqqpfg | 652 |
| | | | pfpqtqqpqqpfpqlqqpqq | 653 |
| 55 | EIEEpEEpI | 54 | qpfpqlqqpqqplpqpqqpq | 654 |
| | | | gfpqlqqpeqplpqqg | 655 |
| | | | qpqqpfpqlqqpqqplpqpq | 656 |
| | | | gfpqlqqpqqplpqqg | 657 |
| 56 | IpEEpEEpF | 55 | gqpipqqpeqpfplqg | 658 |
| | | | fpelqqpipqqpqqpfplqp | 659 |
| | | | fpelqqpipqqpqqpfplqp | 660 |
| | | | gqpipqqpqqpfplqg | 661 |
| | | | gqlqqpipqqpqqpfg | 662 |
| | | | gqlqqpipeqpqqpfg | 663 |
| 57 | FpEEpEEpF | 56 | qqpfpqqpqqpfpqpqqpip | 664 |
| | | | fpqqpqqpfpqpqlpfpqqs | 665 |
| | | | qqflqpqqpfpqqpqqpypq | 666 |
| | | | plqpqqpfpqqpqqpfpqpq | 667 |
| | | | qlpfpqqpqqpfpqpqqpqq | 668 |
| | | | tqqpqqpfpqqpqqpfpqtq | 669 |
| | | | qtqqpqqpfpqqpqqpfpqt | 670 |
| | | | pqpqqpqlpfpqqpqqpfpq | 671 |
| | | | qqpfpqqpqqpfpqtqqpqq | 672 |
| | | | qqpypqqpqqpfpqtqqpqq | 673 |
| | | | gqpfpqqpeqpfpqqg | 674 |
| | | | fplqpqqpfpqqpqqpfpqp | 675 |
| | | | pqqpflqpqqpfpqqpqqpf | 676 |
| | | | plqpqqpfpqqpqqpfpqqp | 677 |
| | | | gqpqqpfpeqpqqpfg | 678 |
| | | | gqpypqqpeqpfpqqg | 679 |
| | | | gqpfpqqpqqpfpqqg | 680 |
| | | | ypqqpfpqqpqqpfpqqppf | 681 |
| | | | qqtfpqqpqlpfpqqpqqpf | 682 |
| | | | pqqgflqpqqpfpqqpqqpy | 683 |
| | | | plqpqqpfpqqpqqpfpqpq | 684 |
| | | | gqpqqpfpqqpqqpfg | 685 |
| | | | rqpfpqqpqqpypqqpqqpf | 686 |
| | | | gqpypqqpqqpfpqqg | 687 |
| | | | qqpfpqqpqqpypqqpqqpf | 688 |
| | | | qpqqpfpqqpqqpfpqtqqp | 689 |
| | | | fpqqpqqpypqqpqqpfpqt | 690 |
| | | | fpqqprqpypqqpqqpfpqt | 691 |
| | | | pfpeqpeqpypqqpq | 692 |
| | | | pfpqqpqqpfpqqpqqsfpq | 693 |
| | | | gqpqlpfpeqpqqpfg | 694 |
| | | | gqpqlpfpqqpqqpfg | 695 |
| | | | pqqpqqsfpqqpqqpypqqg | 696 |
| | | | qqpqqsfpqqpqqpypqqqp | 697 |
| | | | lqpqqpfpqqpqqpypqqpq | 698 |
| | | | pqqgflqprqpfpqqpqqpy | 699 |
| | | | prqpfpqqpqqpypqqpqqp | 700 |
| 58 | SpIEpEEpF | 57 | gqptpiqpeqpfpqgg | 701 |

FIG. 5J

| | | | | |
|---|---|---|---|---|
| | | | ftqpqqptpiqpqqpfpqp | 702 |
| | | | pftqpqqptpiqpqqpfpqq | 703 |
| | | | tpiqpqqpfpqqpqqpqqpf | 704 |
| | | | qqptpiqpqqpfpqqq | 705 |
| 59 | pFSEEpEEI | 58 | gqpfsqqpeqifpqqg | 706 |
| | | | qqpfsqqpqqifpqpqqtfp | 707 |
| | | | qqqqpfpqpqqpfsqqpqqi | 708 |
| | | | hqpfsqqpqqifpqpqqtfp | 709 |
| | | | gqpfsqqpqqifpqqg | 710 |
| | | | pflqphqpfsqqpqqifpqp | 711 |
| | | | gqpqqpfseqpqqifg | 712 |
| | | | qqqpflqphqpfsqqpqqif | 713 |
| | | | qpqqpfsqqpqqifpqpqqt | 714 |
| | | | gqpqqpfsqqpqqifg | 715 |
| 60 | gEEIFpEpE | 59 | gqqifpqpeqtfphqg | 716 |
| | | | gqqifpqpqqtfphqg | 717 |
| 61 | EpEEpEEpF | 60 | pqqpqqpqqpfpqpqqpfpw | 718 |
| | | | pqqpqqpqqpfpqpqqpfpw | 719 |
| | | | pqqpfpqpqqpqqpfpqpqq | 720 |
| | | | pqqqfpqpqqpqqpfpqpqq | 721 |
| | | | qpqqpqqpfpqpqqpqlpfp | 722 |
| | | | pqqpfpqpqqpqqpfpqpqq | 723 |
| | | | qqqpfpqpqqpqqpfpqpq | 724 |
| | | | tpiqpqqpfpqpqqpqqpf | 725 |
| | | | piqpqqpfpqpqqpqqpfp | 726 |
| | | | qqfpqpqqpqqpfpqpqqqq | 727 |
| | | | gqqpfpqpeqpqqpfg | 728 |
| | | | gqpqqqfpqpqqpqqpfpqp | 729 |
| | | | lqqpqqplpqpqqpqqpfpq | 730 |
| | | | gfpqpqqpeqpfpqqg | 731 |
| | | | gfpqpqqpqqpfpqqg | 732 |
| | | | qqpfpqpqqpqqpfpqlqqp | 733 |
| | | | pqqqfpqpqqpqqpfpqqpq | 734 |
| | | | qpqqpqqpfpqqqqpliqpy | 735 |
| | | | pqqpfpqpqqpqqpfpqlqq | 736 |
| | | | gqqpfpqpqqpqqpfg | 737 |
| | | | gqqplpqpeqpqqpfg | 738 |
| | | | pqpqqpqqpfpqqqqpliqp | 739 |
| | | | qqpfpqpqqpqqpfpqsqqp | 740 |
| | | | tfphqpqqqvpqpqqpqqpf | 741 |
| | | | gqqqfpqpqqpqqpfg | 742 |
| | | | gqqplpqpqqpqqpfg | 743 |
| | | | tfphqpqqfpqpqqpqqpf | 744 |
| | | | qqplpqpqqpqqpfpqsqqp | 745 |
| | | | gqqqfpqpeqpqqpfg | 746 |
| | | | qqvpqpqqpqqpflqpqqpf | 747 |
| | | | qqplpqpqqpqqpfpqsqqp | 748 |
| | | | qqvpqpqqpqqpflqpqqpf | 749 |
| 62 | FpEEpEEpI | 61 | pqqaqlpfpqqpqqplpqpq | 750 |
| | | | qaqlpfpqqpqqplpqpqqp | 751 |
| 63 | pSSEEppFp | 62 | qqpfpqqpqqpssqqppfpq | 752 |

FIG. 5K

| | | | | |
|---|---|---|---|---|
| | | | qqqqpssqqppfpqqhqqfp | 753 |
| | | | ppfsqqqqpssqqppfpqqh | 754 |
| 64 | FpEEpEIpF | 63 | pqqpfpqpqqtfpqqpqlpf | 755 |
| | | | fpqpqqtfpqqpqlpfpqqp | 756 |
| | | | qqtfpqqpqlpfpqpqqpf | 757 |
| | | | pqqpfpqpqqtfpqqpqlpf | 758 |
| 65 | pFpFEpEEp | 64 | qpfpqpqqpfpwqpqqpfpq | 759 |
| | | | qpfpqpqqpfpwqpqqpfpq | 760 |
| | | | qpfpqpqqpfpwqpqqpfpq | 761 |
| | | | gqpfpwqpqqpfpqqg | 762 |
| | | | pfpwqpqqpfpqtqqsfplq | 763 |
| | | | gqpfpwqpeqpfpqqg | 764 |
| 66 | pEESFpREg | 65 | gqqifpqpeqtfphqg | 765 |
| | | | gqqafpqpeqtfphqg | 766 |
| | | | gqqifpqpqqtfphqg | 767 |
| | | | gqqtfpqpeqtfphqg | 768 |
| | | | gqqafpqpqqtfphqg | 769 |
| | | | gqqtfpqpqqtfphqg | 770 |
| 67 | SFpREpEEa | 66 | qqifpqpqqtfphqpqqafp | 771 |
| | | | gqtfphqpeqafpqpg | 772 |
| | | | qtfphqpqqafpqpqqtfph | 773 |
| | | | ggtfphqpqqafpqpg | 774 |
| | | | pqgtfphqpqqafpqpqgtf | 775 |
| 68 | FSEEpSFS | 67 | pqqqppfsqqqpsfsqqqpp | 776 |
| 69 | aFpEpEESF | 68 | gqqafpqpeqtfphqg | 777 |
| | | | qafpqpqqtfphqpqqqfpq | 778 |
| | | | qafpqpqqtfphqpqqqfpq | 779 |
| | | | gqqafpqpqqtfphqg | 780 |
| | | | qtfphqpqqafpqpqqtfph | 781 |
| | | | qqafpqpqqtfphqpqqqfp | 782 |
| | | | pqgtfphqpqqafpqpqgtf | 783 |
| 70 | SEEpFSEpE | 69 | qqfpeqsqqpftqpqqptpi | 784 |
| | | | fpeqsqqpftqpqqptpiqp | 785 |
| 71 | IEpFpEpEp | 70 | lqpfpqpqpflpqlpypqpq | 786 |
| | | | lqlqpfpqpqpfppqlpypq | 787 |
| | | | lqlqpfpqpqpflpqlpypq | 788 |
| | | | lqlqpfpqpqpfppqlpypq | 789 |
| | | | mqlqpfpqpqpfppqlpypq | 790 |
| | | | pfpsqqpymqlqpfpqpqpf | 791 |
| | | | fpsqqpylqlqpfpqpqpfl | 792 |
| | | | pfpsqqpylqlqpfpqpqpf | 793 |
| | | | sqqpylqlqpfpqpqpfppq | 794 |
| | | | pfpsqqpymqlqpfpqpqpf | 795 |
| 72 | pFpRpEIpF | 71 | qqpylqlqpfprpqlpypqp | 796 |
| | | | glqpfprpelpypqpg | 797 |
| | | | lqlqpfprpqlpypqpqpfr | 798 |
| | | | glqpfprpqlpypqpg | 799 |
| 73 | EEIFpEpEE | 72 | gqqifpqpeqtfphqg | 800 |
| | | | gqqifpqpqqtfphqg | 801 |
| | | | qqifpqpqqtfphqpqqafp | 802 |
| | | | pqqifpqpqqtfphqpqqqf | 803 |

FIG. 5L

|   |         |    | Sequence | # |
|---|---------|----|----------|---|
|   |         |    | qqifpqpqqtfphqpqqqfp | 804 |
|   |         |    | qqpfsqqpqqifpqpqqtfp | 805 |
|   |         |    | hqpfsqqpqqifpqpqqtfp | 806 |
|   |         |    | qpqqpfsqqpqqifpqpqqt | 807 |
| 74 | EpEESFpER | 73 | pqqqfiqpqqpqqtypqrpq | 808 |
|   |         |    | qpqqqfiqpqqpqqtypqrp | 809 |
|   |         |    | qpfpqqpqqtypqrpqqpfp | 810 |
|   |         |    | pqqpfpqqpqqtypqrpqqp | 811 |
|   |         |    | pqqqfiqpqqpqqtypqrpq | 812 |
|   |         |    | qqpfpqqpqqtypqrpqqpf | 813 |
|   |         |    | qqpfpqqpqqtypqrpqqpf | 814 |
| 75 | FpERpEEpF | 74 | qqtypqrpqqpfpqtqqpqq | 815 |
|   |         |    | qpfpqqpqqtypqrpqqpfp | 816 |
|   |         |    | gqtypqrpqqpfpqtg | 817 |
|   |         |    | gqtypqrpeqpfpqtg | 818 |
|   |         |    | qqpfpqqpqqtypqrpqqpf | 819 |
|   |         |    | qqpfpqqpqqtypqrpqqpf | 820 |
|   |         |    | qqtypqrpqqpfpqtqqpqq | 821 |
|   |         |    | qtypqrpqqpfpqtqqpqqp | 822 |
| 76 | IEpFpEpEI | 75 | ylqlqpfpqpqlpypqpqlp | 823 |
|   |         |    | pymqlqpfpqpqlpypqpql | 824 |
|   |         |    | qlqpfpqpqlpypqpql | 825 |
|   |         |    | qlqpfpqpelpypqpq | 826 |
|   |         |    | lqlqpfpqpelpypqpqpfr | 827 |
|   |         |    | qlqpfpqpelpypqpqp | 828 |
|   |         |    | lqlqpfpqpqlpypqpqpfr | 829 |
|   |         |    | lqlqpfpqpelpypqpelpypqpelpypqpqpf | 830 |
|   |         |    | mqlqpfpqpqlpypqpqlpy | 831 |
|   |         |    | qlqpfpqpelpfpqpg | 832 |
|   |         |    | qlqpfpqpelpypqpql | 833 |
|   |         |    | qlqpfpqpqlpypqpqp | 834 |
|   |         |    | qlqpfpqpqlpypqpq | 835 |
|   |         |    | lqpfpqpelpypqpelpypf | 836 |
|   |         |    | lqlqpfpqpqlpypqpqlpy | 837 |
|   |         |    | qlqpfpqpqlpfpqpg | 838 |
|   |         |    | qlqpfpqpelpylqpg | 839 |
|   |         |    | pylqlqpfpqpqlpysqpqp | 840 |
|   |         |    | qlqpfpqpelpysqpg | 841 |
|   |         |    | lqlqpfpqpqlpylqpqpfr | 842 |
|   |         |    | lqlqpfpqpqlpylqpqpfr | 843 |
|   |         |    | lqlqpfpqpqlpysqpqpfr | 844 |
|   |         |    | lqlqpfpqpqlpypqpqlpypqpqlpypqpqpf | 845 |
|   |         |    | qlqpfpqpqlpysqpg | 846 |
|   |         |    | lqlqpfpqpqlpysqpqfr | 847 |
|   |         |    | qlqpfpqpqlpylqpg | 848 |
|   |         |    | qlqpfpqpelsysqpg | 849 |
|   |         |    | qfpsqlpylqlqpfpqpqlp | 850 |
|   |         |    | lqlqpfpqpqlsysqpqpfr | 851 |
|   |         |    | lqlqpfpqpqlsysqpqpfr | 852 |
|   |         |    | gsglqpfpqpelgsg | 853 |
|   |         |    | pfpsqqpymqlqpfpqpqlp | 854 |

FIG. 5M

| | | | | |
|---|---|---|---|---|
| | | | glqpfpqpql sysqpg | 855 |
| | | | pfpsqlpylqlqpfpqpqlp | 856 |
| | | | pfpsqqpylqlqpfpqqlp | 857 |
| | | | pfpsqqpylqlqpfpqpqlp | 858 |
| 77 | EpFpESEES | 76 | pfpwqpqqpfpqtqqsfplq | 859 |
| | | | qpfpqtqqsfplqpqqpfpq | 860 |
| | | | fpwqpqqpfpqtqqsfplqp | 861 |
| 78 | ESScIpgIE | 77 | metscipglerpwqqqplqq | 862 |
| | | | etscipglerpwqeqplppq | 863 |
| 79 | pIIpRgppF | 78 | sqqqpilprgppfsqqtqpv | 864 |
| 80 | EpEEEFpEp | 79 | gffpqpeqefpqpqg | 865 |
| | | | gqqpfpqpeqefpqpg | 866 |
| | | | sqqpqqpfpqpqqqfpqpqq | 867 |
| | | | gqqpfpqpeqqfpqpg | 868 |
| | | | sqqpqqpfpqpqqqfpqpqq | 869 |
| | | | pqqpfpqpqqqfpqpqpq | 870 |
| | | | qpfpqpqqqfpqpqpqqqsf | 871 |
| | | | gqpfpqqpeqefpqpg | 872 |
| | | | qqpqqpfpqpqqqfpqpqq | 873 |
| | | | gqqqfsqpeqefpqpg | 874 |
| | | | gffpqpqqefpqpqg | 875 |
| | | | sqqpqqpfpqpqqqfpqpqq | 876 |
| | | | gffpqpqqqfpqpqqg | 877 |
| | | | gqqqfsqpqqqfpqpg | 878 |
| | | | gqpfpqqpeqqfpqpg | 879 |
| | | | gqqpfpqpqqqfpqpg | 880 |
| | | | qqpqqqfpqpqpqqpfpqp | 881 |
| | | | gqtfphqpeqqfpqpg | 882 |
| | | | gfpqqpeqefpqpqg | 883 |
| | | | pqqpfpqqpqqqfpqpqpq | 884 |
| | | | gqqqfsqpeqqfpqpg | 885 |
| | | | gffsqpqqefpqpqqg | 886 |
| | | | pqpqqqfpqpqpqqsfpqq | 887 |
| | | | gfpqqpqqefpqpqqg | 888 |
| | | | sqqpqqqfsqpqqqfpqpq | 889 |
| | | | sqqpqqqfsqpqqqfpqpq | 890 |
| | | | qqfsqpeqefpqpqg | 891 |
| | | | qsqpqqqfsqpqqqfpqpq | 892 |
| | | | qpqqqfsqpqqqfpqpqpq | 893 |
| | | | gqpfpqqpqqqfpqpg | 894 |
| | | | qqpqqpfpqpqqqfpqpqq | 895 |
| | | | pqqpqqpfpqpqpqqfpqpq | 896 |
| | | | tfpqpqqtcphqpqqqfpqp | 897 |
| | | | gffsqpqqqfpqpqqg | 898 |
| | | | tfphqpqqqfpqpqqpqqpf | 899 |
| | | | gtfphqpqqqfpqpqqpqqq | 900 |
| | | | gfpqqpqqqfpqpqqg | 901 |
| | | | sqpqqqfpqpqpqqsfpqq | 902 |
| | | | qtcphqpqqqfpqpqpqqqp | 903 |
| | | | gqtfphqpqqqfpqpg | 904 |
| 81 | nmEadpSgE | 80 | nmqadpsgqvqwpqqqpflq | 905 |

FIG. 5N

| | | | atanmqadpsgqvqwpqqqp | 906 |
|---|---|---|---|---|
| 82 | galcSSISn | 81 | fdeeknstgalcsslsnqas | 907 |
| 83 | EFpEEEIpI | 82 | qppfpqqhqfpqqqipvvq | 908 |
| | | | qqplfpqqhqfpqqqipvv | 909 |
| | | | qfpqqqipvvqpsvlqqlnp | 910 |
| 84 | EEEpIIIEE | 83 | sqqqqpfpqqqqplllqqpp | 911 |
| | | | qqqqpillqqppfsqhqqpv | 912 |
| | | | qqqpfpqqqqplllqqppfs | 913 |
| | | | qqqqppfsqqqqpillqqp | 914 |
| | | | pfsqqqqpvllqqqipfvhp | 915 |
| | | | qqqpfpqqqqplllqqppfs | 916 |
| 85 | SEEpEESFp | 84 | qqplsqqpqqtfpqpqqtfp | 917 |
| | | | hqpfsqqpqqtfpqpqqtfp | 918 |
| | | | qpfpqphqpfsqqpqqtfpq | 919 |
| | | | gqplsqqpqqtfpqg | 920 |
| | | | pvpqphqpfsqqpqqtfpqp | 921 |
| | | | gqplsqqpeqtfpqg | 922 |
| | | | qqlvpqlqqplsqqpqqtfp | 923 |
| | | | pqlqqplsqqpqqtfpqpqq | 924 |
| 86 | FRREpEESF | 85 | phqtfhhqpqqtfpqpqqty | 925 |
| | | | qtfhhqpqqtfpqpeqtyph | 926 |
| | | | qtfhhqpqqtfpqpqqtyph | 927 |
| | | | qrtipqphqtfhhqpqqtfp | 928 |
| 87 | RFFFpSSpR | 86 | sgqgqhwyyptspklsgqgq | 929 |
| 88 | REpEEEFSE | 87 | tfphqpqqqfsqpqqpqqqf | 930 |
| | | | qtfphqpqqqfsqpqqpqqq | 931 |
| 89 | SIEEIIEEE | 88 | qqqtlqqilqqqlipcrdvv | 932 |
| | | | tlqqilqqqlipcrdvvlqq | 933 |
| | | | qqqqqqqtlqqilqqqlip | 934 |
| 90 | IEEpIppEE | 89 | pwlqqplppqqtlpqqlqqp | 935 |
| | | | sniiisflkpwlqqplppqq | 936 |
| 91 | pISpEESgE | 90 | qgqqgyypispqqsgqgqqp | 937 |
| 92 | pEpFpEpEp | 91 | pypqpqpfpqpqpfppqlpy | 938 |
| | | | pfpsqqpypqpqpfpqpqpf | 939 |
| | | | pqpqpfpqpqpfppqlpypq | 940 |
| 93 | EpEpFpEpE | 92 | pypqpqpfpqpqpfppqlpy | 941 |
| | | | qqpfpsqqpypqpqpfpqpq | 942 |
| | | | pfpsqqpypqpqpfpqpqpf | 943 |
| | | | pqpqpfpqpqpfppqlpypq | 944 |
| 94 | FpEEpEESF | 93 | pqqgfigpqqpfpqqpqqty | 945 |
| | | | qqqfigpqqpfpqqpqqtyp | 946 |
| | | | pqqgfigpqqpfpqqpqqty | 947 |
| | | | pqqpqqpfpqqpqqsfpqqp | 948 |
| | | | gqpfpqqpeqsfpqqg | 949 |
| | | | qpfpqqpqqtypqrpqqpfp | 950 |
| | | | gqpqqpfpeqpqqsfg | 951 |
| | | | gqpqqpfpqqpqqsfg | 952 |
| | | | pqqpfpqqpqqsfpqqpqqp | 953 |
| | | | pqqpfpqqpqqtypqrpqqp | 954 |
| | | | gqpfpqqpqqsfpqqg | 955 |
| | | | gqpqqpfpeqpqqtfg | 956 |

FIG. 5O

| | | | | |
|---|---|---|---|---|
| | | | pfpqpqqp fpqqpqqsfpq | 957 |
| | | | gqpqqp fpqqpqqtfg | 958 |
| | | | qqp fpqqpqqtypqrpqpf | 959 |
| | | | qqp fpqqpqqtypqrpqpf | 960 |
| 95 | EESFSEEpp | 94 | pwqqqplppqqsfsqqppfs | 961 |
| | | | pwqqqplppqqsfsqqppfs | 962 |
| | | | erpwqqqplppqqsfsqqpp | 963 |
| | | | pqqsfsqqppfsqqqqqplp | 964 |
| | | | qqsfsqqppfsqqqqqplpq | 965 |
| | | | qplppqqsfsqqppfsqqqq | 966 |
| | | | pwqqqplppqqsfsqqppfs | 967 |
| 96 | FpEEpFpEE | 95 | ypqqpfpqqpqqpfpqqppf | 968 |
| | | | yqqqp fpqqpypqqpypsqq | 969 |
| | | | lpqpyaqpylpypqqpfpqq | 970 |
| | | | pqqsfsyqqqp fpqqpypqq | 971 |
| | | | pfpqqpypqqpypsqqpyps | 972 |
| | | | qelqspqql ypqqpypqqpy | 973 |
| | | | yaqpylpypqqpfpqqpqqp | 974 |
| | | | qqp fpqqpypqqpypsqqpy | 975 |
| 97 | EpSSEEpIS | 96 | qpssqqplsqqhqqfpqqqi | 976 |
| | | | qqppfsqqqqpssqqplsqq | 977 |
| 98 | EpIEERESF | 97 | glerpwqqqplqqketfpqq | 978 |
| 99 | ISpEEIgEg | 98 | qqgyypispqqlgqgqqsgq | 979 |
| 100 | EEEccERIp | 99 | qsschvmqqqccqrlpqipe | 980 |
| 101 | agEgEEgFF | 100 | gqqagqgqqgyyptspqqlg | 981 |
| 102 | EEEpFpEpE | 101 | gqvqwpqqqpfpqpqqpfce | 982 |
| | | | pqqqpfpqpqqpfsqpqq | 983 |
| | | | wpqqqpfpqpqqpfcqpqq | 984 |
| | | | qqqqpfpqpqqpqqpfpqqg | 985 |
| | | | psgqvqwpqqqpfpqpqqpf | 986 |
| | | | pqqqpfpqpqqpfceqpqrt | 987 |
| | | | qqqpfpqpqqpfcqqpqrti | 988 |
| | | | psgqvqwpqqqpfpqpqqp | 989 |
| | | | qqqqpfpqpqqpfsqpqqi | 990 |
| | | | gqvqwpqqqqpfpqpqqpqq | 991 |
| | | | psgqvqwpqqqqpfpqpqqp | 992 |
| | | | qqqpfpqpqqpfceqpqrti | 993 |
| | | | vdpsgqvqwpqqqqpfpqpq | 994 |
| 103 | EIEFpEEEE | 102 | psgqvqwpqqqqpfpqpqqp | 995 |
| | | | niqvdpsgqvqwpqqqqpfp | 996 |
| | | | gqvqwpqqqqpfpqpqqpqq | 997 |
| | | | psgqvqwpqqqqpfpqpqqp | 998 |
| | | | ttaniqvdpsgqvqwpqqqq | 999 |
| | | | vdpsgqvqwpqqqqpfpqpq | 1000 |
| | | | qivfpsgqvqwpqqqqpfp | 1001 |
| | | | gqvqwpqqeqpfpqqg | 1002 |
| | | | gqvqwpqqqqpfpqqg | 1003 |
| 104 | EpIEEIccE | 103 | qstyqplqqlccqqlwqipe | 1004 |
| | | | qstyqplqqlccqqlwqipe | 1005 |
| | | | qstyqplqqlccqqlwqipe | 1006 |
| 105 | pFpEpEFpS | 104 | ppqqpypqpqfpsqlpylqi | 1007 |

FIG. 5P

| | | | | |
|---|---|---|---|---|
| | | | gqqqpfppqqpypqpqfpsq | 1008 |
| | | | qqpfppqqpypqpqfpsqlp | 1009 |
| | | | qqpypqpqfpsqlpylqlqp | 1010 |
| 106 | aIESIpSmc | 105 | feeirnlalqtlpsmcnvyi | 1011 |
| | | | rnlalqtlpsmcnvyippyc | 1012 |
| | | | eirnlalqtlpsmcnvyipp | 1013 |
| 107 | RIFEIpERI | 106 | elccqhlwqipeklqcqaih | 1014 |
| | | | elccqhlwqipeklqcqaih | 1015 |
| | | | glccqhlweipeklqg | 1016 |
| | | | glccqhlwqipeklqg | 1017 |
| | | | lccqhlwqipeklqcqaihn | 1018 |
| 108 | pFpESEESF | 107 | pfpwqpqqpfpqtqqsfplq | 1019 |
| | | | qpfpqtqqsfplqpqqpfpq | 1020 |
| | | | fpwqpqqpfpqtqqsfplqp | 1021 |
| | | | pfpqtqqsfplqpqqpfpqq | 1022 |
| 109 | EgFFEpSEE | 108 | gqgffqpsqqnpqaqgsfqp | 1023 |
| | | | gqgffqpsqqnpqaqg | 1024 |
| | | | qqypsgqgffqpsqqnpqaq | 1025 |
| | | | qqypsgqgffqpsqqnpqaq | 1026 |
| | | | gqgffqpseqnpqaqg | 1027 |
| | | | psgqgffqpsqqnpqaqgsf | 1028 |
| | | | qqypsgqgffqpsqqnpqaq | 1029 |
| 110 | ESIFESScR | 109 | arsqtlwqsschvmqqqccr | 1030 |
| 111 | ISSIFSIII | 110 | llqqckpvslvsslwsiilp | 1031 |
| | | | lvsslwsiilppsdcqvmrq | 1032 |
| | | | lvsslwsiilppsdcqvmrq | 1033 |
| 112 | ESFpEpEES | 111 | gqqtfpqpeqtfphqq | 1034 |
| | | | qqtfpqpqqtfphqpqqqfp | 1035 |
| | | | gqqtfpqpqqtfphqq | 1036 |
| | | | qqpqqtfpqpqqtfphqpqq | 1037 |
| | | | phqtfhhqpqqtfpqpqqty | 1038 |
| | | | qqplsqqpqqtfpqpqqtfp | 1039 |
| | | | qtfpqpqqtyphqpqqqfpq | 1040 |
| | | | hqpfsqqpqqtfpqpqqtfp | 1041 |
| | | | qqtfpqpqqtfphqpqqqvp | 1042 |
| | | | qtfpqpeqtyphqpqqqfpq | 1043 |
| | | | qtfhhqpqqtfpqpeqtyph | 1044 |
| | | | hhqpqqtfpqpeqtyphqpq | 1045 |
| | | | qqtfpqpqqtfphqpqqqfs | 1046 |
| | | | qtfpqpqqtyphqpqqqfpq | 1047 |
| | | | qtfhhqpqqtfpqpqqtyph | 1048 |
| | | | hhqpqqtfpqpqqtyphqpq | 1049 |
| 113 | mEnSRIpgI | 112 | menshipglerpsrqqqplpp | 1050 |
| | | | menshipglerlsqqqplpp | 1051 |
| | | | menshipglegpsqqqplpp | 1052 |
| 114 | EEcSpIaIp | 113 | kvflqqcspvaipyrlars | 1053 |
| 115 | pFSEEEEIp | 114 | qppfsqqqqtpfsqqqqipv | 1054 |
| | | | sqqqqppfsqqqqipvihps | 1055 |
| | | | qqqqtpfsqqqqipvihpsv | 1056 |
| 116 | ESRcIpgIE | 115 | etrcipglerpwqqqplppq | 1057 |
| | | | metrcipglerpwqqqplpp | 1058 |

FIG. 5Q

| 117 | IpSIERpIE | 116 | metshipslekplqqqplpl | 1059 |
|---|---|---|---|---|
| | | | cashipslekplqqqplplq | 1060 |
| 118 | aEIpFpEEp | 117 | qqpfpqpqqaqlpfpqqpqq | 1061 |
| | | | pqqaqlpfpqqpqqplpqpq | 1062 |
| | | | qaqlpfpqqpqqplpqpqqp | 1063 |
| | | | qqpfpqpqqaqlpfpqqpqq | 1064 |
| | | | qpfpqpqqaqlpfpqqpqqp | 1065 |
| 119 | SIIIRSIpn | 118 | qqpaqyevirslvlrtlpnm | 1066 |
| | | | qyevirslvlrtlpnmcnvy | 1067 |
| | | | qyevirslvlrtlpnmcnvy | 1068 |
| 120 | aEIEgIRSI | 119 | qpqqpaqlegirslvlktlp | 1069 |
| | | | iiqpqqpaqlegirslvlkt | 1070 |
| 121 | EEpaEIEgI | 120 | qlaqglgiiqpqqpaqlegi | 1071 |
| | | | qpqqpaqlegirslvlktlp | 1072 |
| | | | iiqpqqpaqlegirslvlkt | 1073 |
| 122 | SpIampERI | 121 | ckvflqqcspvampqrlar | 1074 |
| | | | lqqcspvampqrlar | 1075 |
| | | | vflqqcspvampqrlarsqm | 1076 |
| | | | qqqcspvampqrlarsqmwq | 1077 |
| | | | cspvampqrlarsqmwqqss | 1078 |
| | | | qcspvampqhlarsqmwqqs | 1079 |
| | | | ckvflqqcspvampqrlar | 1080 |
| | | | qqqcspvampqrlarsqmwq | 1081 |
| | | | vflqqcspvampqhlarsq | 1082 |
| | | | vflqqcspvampqrlarsq | 1083 |
| | | | spvampqrlarsqmlqqssc | 1084 |
| 123 | EInpCRnFI | 122 | qqlnpcknfllqqckpvslv | 1085 |
| | | | sliqqslqqqlnpcknfllq | 1086 |
| | | | qpslqqqvnpcknfllqqck | 1087 |
| | | | iqqslqqqlnpcknfllqqc | 1088 |
| | | | iqpslqqqvnpcknfllqqc | 1089 |
| | | | lqqqvnpcknfllqqcklvs | 1090 |
| 124 | IEpEEIaEI | 123 | qgtflqpqqvaqlelmtsia | 1091 |
| 125 | EFSEEEEIp | 124 | qqpqfsqqqqipvihpsvlq | 1092 |
| | | | qppfsqqqqpqfsqqqqipv | 1093 |
| 126 | FpEpEpFpp | 125 | lqlqpfpqpqpfppqlpypq | 1094 |
| | | | qpfpsqqpypqqpfppqlp | 1095 |
| | | | pypqpqpfpqpqpfppqlpy | 1096 |
| | | | lqlqpfpqpqpfppqlpypq | 1097 |
| | | | mqlqpfpqpqpfppqlpypq | 1098 |
| | | | qqpfpsqqpypqpqpfppql | 1099 |
| | | | pfpqpqpfppqlpypqpppf | 1100 |
| | | | pfpqpqpfppqlpypqpqsf | 1101 |
| | | | pqpqpfpqpqpfppqlpypq | 1102 |
| | | | sqqpylqlqpfpqpqpfppq | 1103 |
| | | | pfpsqqpypqpqpfppqlpy | 1104 |
| 127 | FpEpEEpFc | 126 | gqqpfpqpeqpfcqqg | 1105 |
| | | | gqvqwpqqqpfpqpqpfce | 1106 |
| | | | wpqqqpfpqpqpfcqqpqq | 1107 |
| | | | gqqpfpqpqpfcqqg | 1108 |
| | | | pqqqpfpqpqpfceqpqrt | 1109 |

FIG. 5R

| | | | | |
|---|---|---|---|---|
| | | | qqqp fpqpqqpfcqgpqrti | 1110 |
| | | | fpqpqqpfcqgpqrtipqph | 1111 |
| | | | qqqp fpqpqqpfcqgpqrti | 1112 |
| 128 | EEIpEIpEE | 127 | ccqqlpqipeqsryeairai | 1113 |
| | | | sschvmqqccqqlpqipqq | 1114 |
| | | | qccqqlpqipqqsryqaira | 1115 |
| | | | qqccqqlpqipqqsryeair | 1116 |
| | | | qccqqlpqipeqsrseaira | 1117 |
| | | | qccqqlpqipqqsryqaira | 1118 |
| | | | hvmqqccqqlpqipqqsry | 1119 |
| | | | qqccqqlpqipeqsrydair | 1120 |
| | | | qccqqlpqipeqsrydvira | 1121 |
| | | | cqqlpqipqqsryeairaii | 1122 |
| 129 | pEESEEIIp | 128 | fpqpqlpfpqqseqiipqql | 1123 |
| | | | pqqseqiipqqlqqpfplqp | 1124 |
| | | | pqqseqiipqqlqqpfplqp | 1125 |
| | | | fpqpqlpfpqqseqiipqql | 1126 |
| 130 | pnnnSpSnR | 129 | plnnnnspnnnspsnhhnns | 1127 |
| | | | nnspnnnspsnhhnnspnnn | 1128 |
| | | | plnnnnspnnnspsnhhnns | 1129 |
| | | | nnnspnnnspsnhhnnspnn | 1130 |
| | | | nnspnnnspsnhhnnspnnn | 1131 |
| 131 | mEEEEEEER | 130 | iimqqeqqeqrqgvqi | 1132 |
| | | | ivhsiimqqeqqeqrqgvqi | 1133 |
| | | | ivhsiimqqeqqeqrq | 1134 |
| | | | sivhsiimqqeqqeqrqgvq | 1135 |
| | | | ivhsiimqqeqqeqrqgvqi | 1136 |
| 132 | EEmnpcRnF | 131 | qqmnpcknfllqqcnhvslv | 1137 |
| | | | iqsflqqqmnpcknfllqqc | 1138 |
| | | | qsflqqqmnpcknfllqqcn | 1139 |
| | | | iqpylqqqmnpcknyllqqc | 1140 |
| | | | iqpylqqqmnpcknyllqqc | 1141 |
| | | | lqqqmnpcknyllqqcnpvs | 1142 |
| 133 | cnInIpIFR | 132 | tmcnvnvplyrtttrvpfgv | 1143 |
| | | | tsfalrtlptmcnvnvplyr | 1144 |
| 134 | IISIIIpRS | 133 | cnhvslvsslvsiilprsdc | 1145 |
| | | | hvslvsslvsiilprsdcqv | 1146 |
| | | | lvsslvsiilprsdcqvmqq | 1147 |
| 135 | EIaEIpEES | 134 | schvmqqccqqlaqipeqs | 1148 |
| | | | qccqqlaqipeqsrheaira | 1149 |
| 136 | RpFIEEpIp | 135 | mesniiisflkpwlqqplpp | 1150 |
| | | | sniiisflkpwlqqplppqq | 1151 |
| 137 | pFpEpEEpE | 136 | qqpfpqpqqpq·pfpqpqq | 1152 |
| | | | pqqpfpqpqqpqqpfpqpqq | 1153 |
| | | | qipfpqpqqpqpfpqpqqpqq | 1154 |
| | | | qpqpqqpfpqpqqpq·pfp | 1155 |
| | | | qqpqqpfpqpqqpq·pfpqq | 1156 |
| | | | sqpqqpfpqpqqpqqsfpq | 1157 |
| | | | qqqpfpqpqqpqqpfpqpq | 1158 |
| | | | qpqqpfpqpqqpq·pfpqq | 1159 |
| | | | pqqpfpqpqqpq·pfpqpq | 1160 |

FIG. 5S

| | | | | |
|---|---|---|---|---|
| | | | skqpqqpfpqpqpqqsfpq | 1161 |
| | | | qskqpqqpfpqpqqsfp | 1162 |
| | | | gqqpfpqpeqpqlpfg | 1163 |
| | | | qqpfpqpqpqlpfpqqpqq | 1164 |
| | | | gqqpfpqpeqpqpfg | 1165 |
| | | | gqqpfpqpqpqlpfg | 1166 |
| | | | qqpfpqpqpqpfpqlqqp | 1167 |
| | | | gqqpfpqpeqpqqsfg | 1168 |
| | | | ggvqwpqqqpfpqpqpqq | 1169 |
| | | | pqqpfpqpqpqpfpqlqq | 1170 |
| | | | gqqpfpqpqpqqpfg | 1171 |
| | | | gqqpfpqpqpqqsfg | 1172 |
| | | | qqpfpqpqpqpfpqsqqp | 1173 |
| | | | pfpqpqqpqqsfpqqqqpli | 1174 |
| 138 | FpEpEEpEE | 137 | pqqpfpqpqpqqpfpqpqq | 1175 |
| | | | qlpfpqqpqpfpqpqpqq | 1176 |
| | | | pqqqfpqpqpqqpfpqqpq | 1177 |
| | | | qpfpqpqqqfpqpqpqqsf | 1178 |
| | | | sqqpqqpfpqpqpqqsfpq | 1179 |
| | | | qqqqpfpqpqpqqpfpqpq | 1180 |
| | | | skqpqqpfpqpqpqqsfpq | 1181 |
| | | | qqfpqpqpqqqflqpqqpf | 1182 |
| | | | qskqpqqpfpqpqqsfp | 1183 |
| | | | qqfpqpqqpqqpfpqqpqqg | 1184 |
| | | | gqqpfpqpeqpqqpfg | 1185 |
| | | | gfpqpqqpeqsfpqqg | 1186 |
| | | | qqpqqqfpqpqqpqqpfpqp | 1187 |
| | | | gfpqpqqpeqpfpqqg | 1188 |
| | | | pqpqqqfpqpqqpqqsfpqq | 1189 |
| | | | gqqqfpqpqpqqsfg | 1190 |
| | | | gfpqpqqpqqpfpqqg | 1191 |
| | | | fpqpqqpqqqflqprqpfpq | 1192 |
| | | | qqpfpqpqpqqpfpqlqqp | 1193 |
| | | | pqqqfpqpqpqqpfpqqpq | 1194 |
| | | | gqqpfpqpeqpqqsfg | 1195 |
| | | | ggvqwpqqqpfpqpqpqq | 1196 |
| | | | pqqpfpqpqpqqpfpqlqq | 1197 |
| | | | gqqpfpqpqpqqpfg | 1198 |
| | | | gqqpfpqpqpqqsfg | 1199 |
| | | | qqpfpqpqpqqpfpqsqqp | 1200 |
| | | | gfpqpqqpqqsfpqqg | 1201 |
| | | | pfpqpqqpqqsfpqqqqpli | 1202 |
| | | | gqqqfpqpqpqqsfg | 1203 |
| | | | gqqqfpqpqpqqpfg | 1204 |
| | | | tfphqpqqqfpqpqpqqpf | 1205 |
| | | | qtfphqpqqqfpqpqpqqg | 1206 |
| | | | sqpqqqfpqpqpqqsfpqq | 1207 |
| | | | qtcphqpqqqfpqpqpqqp | 1208 |
| | | | gqqqfpqpeqpqqpfg | 1209 |
| | | | qqfpqpqqpqqqflqprqpf | 1210 |
| | | | qqfpqpqqpqqqflqpqqpf | 1211 |

FIG. 5T

| | | | | |
|---|---|---|---|---|
| 139 | EEIEEIccE | 138 | lqqssyqqlqqlccqqlfqi | 1212 |
| | | | qssyqqlqqlccqqlfqipe | 1213 |
| 140 | pEESFpEES | 139 | pqqsfpqqsqqsqqpfaqpq | 1214 |
| | | | pqpqqpipvqpqqsfpqqsq | 1215 |
| | | | qpqqpipvqpqqsfpqqsqq | 1216 |
| | | | vqpqqsfpqqsqqsqqpfaq | 1217 |
| 141 | IFpEpEpEF | 140 | rpqqlypqpqpqysqpqqpi | 1218 |
| | | | qpfrpqqlypqpqpqysqpq | 1219 |
| 142 | EEpFpEEpE | 141 | qqpfpqqpqqpfpqpqqpip | 1220 |
| | | | qqflqpqqpfpqqpqqpypq | 1221 |
| | | | plqpqqpfpqqpqpfpqpq | 1222 |
| | | | pqqfiqpqqpfpqqpqqty | 1223 |
| | | | pqqpfpqqpqqfpqpqqpq | 1224 |
| | | | pqqfpqpqqpqqpfpqqpq | 1225 |
| | | | tqqpqqpfpqqpqqpfpqtq | 1226 |
| | | | pqqpfpqqpqqpqqpfpqpq | 1227 |
| | | | qqpfpqtqqpqqpfpqqpqq | 1228 |
| | | | qtqqpqqpfpqqpqqpfpqt | 1229 |
| | | | qqpqqpfpqqpqqfpqpqq | 1230 |
| | | | qqpfpqqpqqpfpqtqqpqq | 1231 |
| | | | tpiqpqqpfpqqpqqpqqpf | 1232 |
| | | | qqpypqqpqqpfpqtqqpqq | 1233 |
| | | | qqqfiqpqqpfpqqpqqtyp | 1234 |
| | | | piqpqqpfpqqpqpqqpfp | 1235 |
| | | | pqqfiqpqqpfpqqpqqty | 1236 |
| | | | qqfpqpqqpqqpfpqqpqqq | 1237 |
| | | | fplqpqqpfpqqpqpfpqp | 1238 |
| | | | pqqpfiqpqqpfpqqpqqpf | 1239 |
| | | | piqpqqpfpqqpqqpfpqqp | 1240 |
| | | | qqpqqpfpeqpqqpfg | 1241 |
| | | | ypqqpfpqqpqqpfpqqppf | 1242 |
| | | | pqqpqqpfpqqpqqsfpqqp | 1243 |
| | | | pqqpfpqqpqqfpqpqqpq | 1244 |
| | | | qqpfpqtpqqpssqqppfpq | 1245 |
| | | | pqqfiqpqqpfpqqpqqpy | 1246 |
| | | | piqpqqpfpqqpqqpfpqpq | 1247 |
| | | | pqqqfpqpqqpqqpfpqqpq | 1248 |
| | | | qqpqqpfpqqpqqpfg | 1249 |
| | | | rqpfpqqpqqpypqqpqqpf | 1250 |
| | | | qqpqqpfpeqpqqsfg | 1251 |
| | | | qqpqqpfpqqpqqsfg | 1252 |
| | | | pqqpfpqqpqqsfpqqpqqp | 1253 |
| | | | qqpfpqqpqqpypqqpqqpf | 1254 |
| | | | qpqqpfpqqpqqpfpqtqqp | 1255 |
| | | | qqpfpqtqqpqqpfpqqpqq | 1256 |
| | | | fpqqpqqpypqqpqqpfpqt | 1257 |
| | | | pqqpfpqqpqqtypqrpqqp | 1258 |
| | | | qqpqqpfpqqpqqfpqpqq | 1259 |
| | | | pfpeqpeqpypqqpq | 1260 |
| | | | qqpqqpfpeqpqqtfg | 1261 |
| | | | pfpqqpqqpfpqqpqqsfpq | 1262 |

FIG. 5U

|     |          |     |                              |      |
|-----|----------|-----|------------------------------|------|
|     |          |     | gqpqqpfpqqpqqtfg             | 1263 |
|     |          |     | yaqpylpypqqpfpqqpqqp         | 1264 |
|     |          |     | pqqpqqpfpqqpqqfpqpq          | 1265 |
|     |          |     | gqpqqpfpeqpqqqfg             | 1266 |
|     |          |     | pqqpqqpypqqpqqlfpqtq         | 1267 |
|     |          |     | gqpqqpfpqqpqqqfg             | 1268 |
|     |          |     | qqpfpqqpqqtypqrpqqpf         | 1269 |
|     |          |     | qqpfpqqpqqtypqrpqqpf         | 1270 |
|     |          |     | lqpqqpfpqqpqqpypqpq          | 1271 |
|     |          |     | prqpfpqqpqqpypqqpqp          | 1272 |
| 143 | EIaEIEImS | 142 | qgtflqpqqvaqlelmtsia         | 1273 |
|     |          |     | qpqqqqlahqiaqlevmtsi         | 1274 |
|     |          |     | qphqiaqlevmtsialrilp         | 1275 |
|     |          |     | phqiaqlevmtsfalrtlpt         | 1276 |
|     |          |     | hqiaqlevmtsialrilptm         | 1277 |
|     |          |     | gtllqphqiaqlevmtsial         | 1278 |
|     |          |     | qiaqlevmtsfalrtlptmc         | 1279 |
|     |          |     | tllqphqiaqlelmtsialr         | 1280 |
|     |          |     | flqphqiaqlevmtsiaprt         | 1281 |
|     |          |     | qgtflqphqiaqlevmtsia         | 1282 |
|     |          |     | qiaqlevmtsialrilptmc         | 1283 |
| 144 | FEIpEESEc | 143 | elccqhlwqipeqsqcqaih         | 1284 |
|     |          |     | hlwqipeqsqcqaiqnvvha         | 1285 |
|     |          |     | qhlwqipeqsqcqaihkvvh         | 1286 |
|     |          |     | elccqhlwqipeqsqcqaih         | 1287 |
| 145 | EEESEEEIg | 144 | qsgqglsqsqqqsqqqlgqc         | 1288 |
|     |          |     | qsdqgvsqsqqqsqqqlgqc         | 1289 |
|     |          |     | qgvsqsqqqsqqqlgqcsfq         | 1290 |
|     |          |     | filsvsqpqqqsqqqlgqq          | 1291 |
|     |          |     | qcvsqpqqqsqqqlgqpqq          | 1292 |
|     |          |     | qqsgqgvsqsqqqsqqqlgq         | 1293 |
|     |          |     | cvsqpqqqsqqqlgqpqqq          | 1294 |
|     |          |     | yqpqqqsqqqlgqcsfqpq          | 1295 |
|     |          |     | qsqqqsqqqlgqcsfqpqq          | 1296 |
|     |          |     | qpqqqsqqqlgqpqqqqq           | 1297 |
|     |          |     | qlgqcvsqpqqqsqqqlgqq         | 1298 |
|     |          |     | qlgqcvsqpqqqsqqqlgqq         | 1299 |
| 146 | SIIEpSIIE | 145 | isivqpsilqqlnpckvflq         | 1300 |
|     |          |     | pqqqisivqpsvlqqlnpck         | 1301 |
|     |          |     | qqqlpqqqisivqpsilqql         | 1302 |
| 147 | FSaSSSIRF | 146 | plysattsvrfgvgtgvgay         | 1303 |
|     |          |     | vplysattsvrfgvgtgvga         | 1304 |
| 148 | REEEEEEEI | 147 | aiimhqqeqqqlqqqqqqq          | 1305 |
|     |          |     | gqmhqqeqqqlqqqg              | 1306 |
|     |          |     | hqqeqqqlqqqqqqlqqq           | 1307 |
|     |          |     | iimhqqeqqqlqqqqqql           | 1308 |
|     |          |     | gqmhqqeqeqqlqqqg             | 1309 |
| 149 | IIEEEISpc | 148 | lqqilqqqltpcmdvvlqqh         | 1310 |
|     |          |     | qqqqeqqilqqilqqqltpc         | 1311 |
|     |          |     | ilqqilqqqltpcmdvvlqq         | 1312 |
| 150 | EEIIpEEEI | 149 | qqvlpqqqipfvhpsilqql         | 1313 |

FIG. 5V

| | | | | |
|---|---|---|---|---|
| | | | qlppfsqqqqqvlpqqqipf | 1314 |
| 151 | FSEEEEpFp | 150 | fsqqqqpqfsqqqqpfpqqq | 1315 |
| | | | fsqqqqpqfsqqqqpfpqqq | 1316 |
| | | | ppfsqqqqpqfsqqqqpfpq | 1317 |
| 152 | cIpgIERpF | 151 | metscipglerpwqqqplqq | 1318 |
| | | | etrcipglerpwqqqplppq | 1319 |
| | | | mrcipglerpwqqqplppqq | 1320 |
| | | | metrcipglerpwqqqplpp | 1321 |
| | | | mdtscipglerpwqqqplpp | 1322 |
| | | | etscipglerpwqeqplppq | 1323 |
| 153 | EEEcIpIam | 152 | mvflqqqcipvamqrclars | 1324 |
| | | | lnpckvflqqqcipvamqrc | 1325 |
| 154 | EIaEIpREI | 153 | vmqqqccqqlaqiprqlqca | 1326 |
| | | | qccqqlaqiprqlqcaaihs | 1327 |
| | | | mqqqccqqlaqiprqlqcaa | 1328 |
| | | | qlaqiprqlqcaaihsvvhs | 1329 |
| 155 | EEpREFpEE | 154 | hhqqqpiqqqphqfpqqqpc | 1330 |
| 156 | RpmFIEpEE | 155 | ypqqrpmylqpqqpisqqqa | 1331 |
| | | | sfppqqpypqqrpmylqpqq | 1332 |
| | | | ypqqrpmylqpqqpisqqqa | 1333 |
| 157 | IEEEmnpcR | 156 | iqsflqqqmnpcknfllqqc | 1334 |
| | | | qsflqqqmnpcknfllqqcn | 1335 |
| | | | iqpylqqqmnpcknyllqqc | 1336 |
| | | | pqqqqpaiqsflqqqmnpck | 1337 |
| | | | iqpylqqqmnpcknyllqqc | 1338 |
| | | | lqqqmnpcknyllqqcnpvs | 1339 |
| 158 | SRIISpRgR | 157 | srllsprgkelhtpqeqfpq | 1340 |
| | | | srllsprgkelhtpqeqfpq | 1341 |
| 159 | REEEEEEp | 158 | iilhqqqqqqpssqvslqq | 1342 |
| 160 | dcEImEEEc | 159 | ilprsdcqvmqqqccqqlaq | 1343 |
| | | | smilprsdcqvmqqqccqql | 1344 |
| | | | vsiilprsdcqvmqqqccqq | 1345 |
| 161 | SEpEIpFSE | 160 | qpylqlqpfsqpqlpysqpq | 1346 |
| | | | lqlqpfsqpqlpysqpqpfr | 1347 |
| | | | sqqpylqlqpfsqpqlpysq | 1348 |
| | | | lqlqpfsqpqlpysqpqpfr | 1349 |
| 162 | EIpFSEEEE | 161 | qqqpilpqlpfsqqqqpvlp | 1350 |
| | | | plisqqqqlpfsqqqqpqfs | 1351 |
| | | | psflqqqpilpqlpfsqqqq | 1352 |
| 163 | EEpFpIEpE | 162 | pqqpqqpfplqpqqpfpqqp | 1353 |
| | | | pqqpqqpfplqpqqpfpqqp | 1354 |
| | | | pqqlqqpfplqpqqpfpqqp | 1355 |
| | | | pqqpqqpfplqpqqpfpqqp | 1356 |
| | | | pqqpfplqpqqsflwqsqqp | 1357 |
| | | | seqiipqqlqqpfplqpqqp | 1358 |
| | | | pqqpfplqpqqsflwqsqqp | 1359 |
| 164 | RFdaIRaII | 163 | pripeqsrydairaiiysiv | 1360 |
| | | | qsrydairaiiysivlqeqq | 1361 |
| | | | qsrydairaiiysivlqeqq | 1362 |
| | | | pripeqsrydairaiiysiv | 1363 |
| 165 | ESRFdaIRa | 164 | pripeqsrydairaiiysiv | 1364 |

FIG. 5W

| | | | | |
|---|---|---|---|---|
| | | | qsrydairaiiysivlqeqq | 1365 |
| | | | peqsrydairaitypiilqe | 1366 |
| | | | qccqqlpripeqsrydaira | 1367 |
| | | | eqsrydairaitysiilqeq | 1368 |
| | | | qccqqlpripeqsrydaira | 1369 |
| | | | qsrydairaiiysivlqeqq | 1370 |
| | | | pripeqsrydairaiiysiv | 1371 |
| 166 | EpSpEpEEI | 165 | flqqpqqpspqpqqvvqiis | 1372 |
| | | | sqqpflqqpqqpspqpqqvv | 1373 |
| | | | pqqpspqpqqvvqiispatp | 1374 |
| 167 | SIREEpIIp | 166 | qppfslhqqpvlpqqqipyv | 1375 |
| | | | qppfslhqqpvlpqqqipyv | 1376 |
| | | | qpilpqqppfslhqqpvlpq | 1377 |
| | | | qpilpqqppfslhqqpvlpq | 1378 |
| 168 | ppFSIREEp | 167 | qqqqqpilpqqppfslhqqp | 1379 |
| | | | qppfslhqqpvlpqqqipyv | 1380 |
| | | | qppfslhqqpvlpqqqipyv | 1381 |
| | | | qpilpqqppfslhqqpvlpq | 1382 |
| | | | qpilpqqppfslhqqpvlpq | 1383 |
| 169 | FpIIIEEEE | 168 | dairaitypiilqeqqqgfv | 1384 |
| 170 | FSEEEEppF | 169 | pfsqqqqppfsqqqqpvlpq | 1385 |
| | | | qqppfsqqqqppfsqqplis | 1386 |
| | | | qpsfsqqqqppfsqqqppfs | 1387 |
| | | | qqqqpftqqqqppfsqqppi | 1388 |
| | | | ppfsqqqqpsfsqqqqppfs | 1389 |
| | | | qqqqppfsqqqqppfsqqqq | 1390 |
| | | | sqqqqappfsqqqqppfsqq | 1391 |
| | | | fsqqqqpqfsqqqqppysqq | 1392 |
| | | | psfsqqqqppftqqqqppf | 1393 |
| | | | vlpqqppfsqqqqppfrsst | 1394 |
| | | | isqqqqappfsqqqqppfsq | 1395 |
| | | | ppfsqqqqppfsqqqqspfs | 1396 |
| | | | fsqqqqppfrssthssqqpp | 1397 |
| | | | isqqqqpppfsqqqqppfsq | 1398 |
| | | | qppysqqqqppysqqqqppf | 1399 |
| | | | qrqlppfsqqqqppfsqqqq | 1400 |
| | | | fsqqqqppfsqqqqppysqq | 1401 |
| | | | eqqppfsqqqqppfsqqqqp | 1402 |
| | | | pfsqqqqppfsqhqqpvlpq | 1403 |
| | | | ysqqqqppysqqqqppfsqq | 1404 |
| | | | qqqqqqqpftqqqqppfsq | 1405 |
| | | | fsqqqqppfsqqqqqppftq | 1406 |
| | | | qqqqppfsqeqqppfsqqqq | 1407 |
| | | | ftqqqqppfsqqspisqqqq | 1408 |
| | | | niqqqqppfsqqqqppfsqq | 1409 |
| | | | qqqqppftqqqqppfsqqspi | 1410 |
| 171 | EREEpIIpE | 170 | sqhqqpvlpqqqipsvqpsi | 1411 |
| | | | qqplfsqkqqpvlpqqpafs | 1412 |
| | | | plfsqkqqpvlpqqppfsqq | 1413 |
| | | | sqqqqppfsqhqqpvlpqqq | 1414 |
| | | | pfsqqqqppfsqhqqpvlpq | 1415 |

FIG. 5X

| 172 | EEppFSEES | 171 | fsqqppfsqqtqpvlpqqs | 1416 |
|---|---|---|---|---|
| | | | ftqqqqppfsqqspisqqq | 1417 |
| | | | qqqppftqqqppfsqqspi | 1418 |
| 173 | EEEEEEEEp | 172 | qqqqqqqqplsqvsfqqpq | 1419 |
| | | | qqqqqqqqplsqvcfqqsq | 1420 |
| | | | pfsqqqqqqqqppfsqqq | 1421 |
| | | | gsgqqqqqqeqpgsg | 1422 |
| | | | ppfsqqqqqqqqpfpqqpsf | 1423 |
| | | | qqqqspfsqqqeqqqppfl | 1424 |
| | | | spisqqqqqqqqqqqpftq | 1425 |
| | | | sqqqeqqqqppflqqqppf | 1426 |
| | | | gqqqqqqqeqplsqvg | 1427 |
| | | | qqlqqqqqqqqqqqpssqv | 1428 |
| | | | qqqqppftqqqqqqqqqpf | 1429 |
| | | | gqqqqqqqqplsqvg | 1430 |
| | | | qqqqqqqqpssqvsfqqpq | 1431 |
| | | | qqqqqqqqpftqqqppfsq | 1432 |
| | | | qqppfsqqqqqqqqpfpqq | 1433 |
| | | | qqlqqqqqqqqqplsqvcf | 1434 |
| | | | qqlqqqqqqqqqplsqvsf | 1435 |
| | | | ilhqqhhhhqqqqqqqqqp | 1436 |
| | | | qqppfsqqqqqqqqppfsq | 1437 |
| | | | qqqqqqqqplsqvsfqqpq | 1438 |
| | | | hhhqqqqqqqqqplsqvsf | 1439 |
| | | | aiilhqqqqqqqqqqqpls | 1440 |
| 174 | EEEEppFS | 173 | pfsqqqqqqqqppfsqqq | 1441 |
| | | | sqqqppfsqqqqppfsqqq | 1442 |
| | | | isqqqqppfsqqqqpqfsq | 1443 |
| | | | psfsqqqqppftqqqqppf | 1444 |
| | | | fsqqqqppfsqqqqppftq | 1445 |
| | | | qqppfsqqqqqqqqppfsq | 1446 |
| 175 | pSIEpSIIE | 174 | qipsvqpsilqqlnpcklfl | 1447 |
| | | | pvlpqqqipsvqpsilqqln | 1448 |
| 176 | pEEEIgEEp | 175 | qqqlgqcsfqqpqqqlgqqp | 1449 |
| | | | qlssqvsfqqpqqqlgqqpq | 1450 |
| | | | sfqqpqqqlgqqpqqqqqqv | 1451 |
| | | | qpqqqlgqqpqqqqqqvlq | 1452 |
| | | | sfqqpqqqlgqqpqqqqqqv | 1453 |
| | | | qqqlgqcsfqqpqqqlgqqp | 1454 |
| | | | csfqqpqqqlgqqpqqqqqq | 1455 |
| 177 | cSFEEpEEE | 176 | qqqlgqcsfqqpqqqlgqqp | 1456 |
| | | | lgqcsfqqpqqqlgqwpqq | 1457 |
| | | | sqqqllqcsfqqpqqqlgqq | 1458 |
| | | | qsqqqlgqcsfqqpqqqlgq | 1459 |
| | | | qqqlgqcsfqqpqqqlgqqp | 1460 |
| | | | csfqqpqqqlgqpqqqqq | 1461 |
| 178 | REIccERIF | 177 | gplrelccqhlwqipg | 1462 |
| | | | qstyqllrelccqhlwqipe | 1463 |
| | | | qstyqllrelccqhlwqipe | 1464 |
| | | | gplrelccehlwqipg | 1465 |
| | | | qstyqllrelccqhlwqipe | 1466 |

FIG. 5Y

| | | | | |
|---|---|---|---|---|
| 179 | IEEEpIIpE | 178 | peppfslqqqpvlpqqspfs | 1467 |
| | | | qqpilpeppfslqqqpvlpq | 1468 |
| | | | psflqqqpilpqlpfsqqqq | 1469 |
| | | | pfsqqqpsflqqqpilpqlp | 1470 |
| 180 | ERppFSEEE | 179 | qrppfsqqqqpvlpqqppf | 1471 |
| | | | lqqppfsqqrppfsqqqqp | 1472 |
| | | | qrppfsqqqqpvlpqqppf | 1473 |
| | | | lqqppfsqqrppfsqqqqp | 1474 |
| 181 | mIFIEEEcI | 180 | svlqqlnpcmvflqqqcipv | 1475 |
| | | | mvflqqqcipvamqrclars | 1476 |
| 182 | EEERpFIEp | 181 | qqsfpqqqrpfiqpslqqql | 1477 |
| | | | qpqqpqqsfpqqqrpfiqps | 1478 |
| | | | fpqqqrpfiqpslqqqlnpc | 1479 |
| 183 | SFpEIpgEI | 182 | gyyptfpqlpgqlqqpaqgq | 1480 |
| 184 | IEEEIIpEI | 183 | ggqvqwlqeqlvpqlg | 1481 |
| | | | psgqvqwlqqqlvpqlqqpl | 1482 |
| | | | ggqvqwleeqlvpqlg | 1483 |
| | | | ggqvqwlqqqlvpqlg | 1484 |
| | | | psgqvqwlqqqlvpqlqqpl | 1485 |
| 185 | ppFIEpSIE | 184 | fpqqqppfiqpslqqqvnpc | 1486 |
| | | | pqqqppfiqpslqqqvnpck | 1487 |
| | | | qqpqqsfpqqqppfiqpslq | 1488 |
| 186 | IIpEEpaFS | 185 | qqplfsqkqqpvlpqqpafs | 1489 |
| | | | kqqpvlpqqpafsqqqqtvl | 1490 |
| | | | qqqtvlpqqpafsqqqhqql | 1491 |
| 187 | pEpEEEIpE | 186 | lqqpqqpfpqpqqqlpqpqq | 1492 |
| | | | gqqpfpqpeqqlpqpg | 1493 |
| | | | lqqpqqpfpqpqqqlpqpqq | 1494 |
| | | | gqqpfpqpqqqlpqpg | 1495 |
| | | | qpfpqpqqqlpqpqqpqqsf | 1496 |
| | | | pqpqqqlpqpqqpqqsfpqq | 1497 |
| 188 | gSanmEIdp | 187 | gtanmqvdpssvqwpqqqp | 1498 |
| | | | gtanmqvdpssvqwpqqqp | 1499 |
| | | | gtanmqvdpssvqwpqqqp | 1500 |
| 189 | EEEgmRIFI | 188 | qqqqqqqqqgmhiflplsqq | 1501 |
| | | | imqqqqqqqqqgmhiflpl | 1502 |
| | | | qqqqgmhiflplsqqqqvgq | 1503 |
| 190 | RIIRaIIIR | 189 | cqaihkvvhaiilhqqqkqq | 1504 |
| | | | qaihkvvhaiilhqqqkqqq | 1505 |
| 191 | IpIFgSSSS | 190 | lrtlpmmcsvnvpvygttts | 1506 |
| | | | lptmcgvnvplygtttsvpf | 1507 |
| | | | vpvygtttsvpfgvtqvga | 1508 |
| | | | csvnvpvygtttsvpfgvgt | 1509 |
| 192 | pEEIgEEpE | 191 | pqpqqlgqpqqqevpqvaf | 1510 |
| | | | qcsfqqpqpqqlgqpqqqe | 1511 |
| 193 | ESgEEEIIE | 192 | qgvsqpqqqsgqqqlvqcsf | 1512 |
| | | | qsgqqqlvqcsfqqpqpqql | 1513 |
| 194 | FppEIpFpE | 193 | pqpfppqlpypqpqlpypqp | 1514 |
| | | | pqpfppqlpypqpqlpypqp | 1515 |
| | | | qpfppqlpypqpqpfpqqp | 1516 |
| | | | pqpfppqlpypqpqlpypqp | 1517 |

FIG. 5Z

|     |          |     | sequence                      |      |
| --- | -------- | --- | ----------------------------- | ---- |
|     |          |     | lqlqpfpqpqpfppqlpypq          | 1518 |
|     |          |     | pqpfppqlpypqpqpfrpqq          | 1519 |
|     |          |     | pqpfppqlpypqpppfspqq          | 1520 |
|     |          |     | lqlqpfpqpqpfppqlpypq          | 1521 |
|     |          |     | pqpfppqlpypqpqsfppqq          | 1522 |
|     |          |     | mqlqpfpqpqpfppqlpypq          | 1523 |
|     |          |     | qqpqpfppelpypqpg              | 1524 |
|     |          |     | qqpqpfppqlpypqpg              | 1525 |
|     |          |     | pfpqpqpfppqlpypqpppf          | 1526 |
|     |          |     | pfpqpqpfppqlpypqpqsf          | 1527 |
|     |          |     | pqpqpfpqpqpfppqlpypq          | 1528 |
|     |          |     | pqpfppqlpypqpppfspqq          | 1529 |
|     |          |     | gsgfppelpypqgsg               | 1530 |
|     |          |     | pqpqpfppqlpypqtqpfpp          | 1531 |
|     |          |     | pqpfppqlpypqtqpfppqq          | 1532 |
|     |          |     | qpfppqlpypqtqpfppqqp          | 1533 |
| 195 | cSpIampER | 194 | ckvflqqcspvampqrlar          | 1534 |
|     |          |     | lqqcspvampqrlar               | 1535 |
|     |          |     | vflqqcspvampqrlarsqm          | 1536 |
|     |          |     | lnpckvflqqcspvampqr           | 1537 |
|     |          |     | qqqcspvampqrlarsqmwq          | 1538 |
|     |          |     | cspvampqrlarsqmwqgss          | 1539 |
|     |          |     | qcspvampqhlarsqmwqgs          | 1540 |
|     |          |     | ckvflqqcspvampqrlar          | 1541 |
|     |          |     | qlnpckvflqqcspvampqr          | 1542 |
|     |          |     | qqqcspvampqrlarsqmwq          | 1543 |
|     |          |     | vflqqcspvampqhlarsq           | 1544 |
|     |          |     | vflqqcspvampqrlarsq           | 1545 |
| 196 | dEESgEqEE | 195 | sgqrqqdqqsgqgqqpgqrg          | 1546 |
| 197 | EIEESIIFg | 196 | ttppqqlqqsilwgipallr          | 1547 |
| 198 | pFSEEEIpI | 197 | qqppfsqqelpilpqqppfs          | 1548 |
|     |          |     | qqqppfsqqppfsqqelpi           | 1549 |
|     |          |     | fsqqppfsqqelpilpqqp           | 1550 |
| 199 | SSRIpgIER | 198 | metshipglekpsqqqplpl          | 1551 |
|     |          |     | metsrvpglekpwqqqplpp          | 1552 |
| 200 | SIaIRSIpm | 199 | lmtsialrtlpmmcsvnvpv          | 1553 |
|     |          |     | hlevmtsialrtlpmmcsvn          | 1554 |

FIG. 5AA

```
Sequence 1:      P(QR)P(QE)LP(FY)PQ  (SEQ ID NO: 1555)
     Optimal responding peptide: PQLPYPQPQLPYPQPQPFRP (SEQ ID NO: 1556)
     High grade peptide:    QLQPFPQPELPYPQPQP (SEQ ID NO: 1557)
     Groups included: 1,2,7,8,10,16,22,23,72

Sequence 2:      P(FY)P(QR)P(QE)LP(FY) (SEQ ID NO: 1558)
     Optimal responding peptide: PQLPYPQPQLPYPQPQPFRP (SEQ ID NO: 1559)
     High grade peptide:    QLQPFPQPELPYPQPQP (SEQ ID NO: 1560)
     Groups included: 1,2,7,8,10,16,22,23,72, 76 PART Sequence 3:      (PIAT)FPQ(PT)(QE)Q(PTS)(FITY) (SEQ ID NO: 1561)
     Optimal responding peptide: QPFPQPQQPFPWQPQQPFPQ (SEQ ID NO: 1562)
     High grade peptides:   GQQPFPQPEQPFPWQG (SEQ ID NO: 1563)
                            GQQPFPQPEQPIPVQG (SEQ ID NO: 1564)
     Groups included:
3,5,6,9,20,24,29,60,69,70,73,74,77,102PT,108,112

Sequence 4:      PQ(PT)(QE)Q(PTS)(FIY)(PS)(VWHQL) (SEQ ID NO: 1565)
     Optimal responding peptide: QPFPQPQQPFPWQPQQPFPQ (SEQ ID NO: 1566)
     High grade peptide:    GQQPFPQPEQPFPWQG (SEQ ID NO: 1567)
                            GQQPFPQPEQPIPVQG (SEQ ID NO: 1568)
     Groups included: 3,5,6,9,20,60,66,69,73,74,77,PART 86
     (3 AND 4 OVERLAP)
     Status: Similar to Sequence 3

Sequence 5:      (KQW)(QR)P(QE)Q(SPIT)(FLY)PQ (SEQ ID NO: 1569)
     Optimal responding peptide: QPQLPFPQQPQQQPQQPFPQ (SEQ ID NO: 1570)
     High grade peptide:    GFPQTQQPEQPFPQQG (SEQ ID NO: 1571)
     Groups included: 11,12,32,54,55,56,59,61,62,65

Sequence 6:      P(FIYL)(PS)(QE)(QR)P(QE)Q(PT) (SEQ ID NO: 1572)
     Optimal responding peptide: PLQPQQPFPQQPQQPFPQPQ (SEQ ID NO: 1573)
     High grade peptide:    GQPFPEQPQQPFPQQG (SEQ ID NO: 1574)
     Groups included: 32PT,54,55,56,57,61,62,63PT,75,85.94PT Sequence 7:      FLP(QE)LPYPQ (SEQ ID NO: 1575)
     Optimal responding peptide: LQLQPFPQPQPFLPQLPYPQ (SEQ ID NO: 1576)
     High grade peptide:    PQPQPFLPELPYPQPQS (SEQ ID NO: 1577)
     Groups included: 13,27,71 PART Sequence 8:      LQQIL(QE)QQL (SEQ ID NO: 1578)
     Optimal responding peptide: LQQILQQQLTPCMDVVLQQH (SEQ ID NO: 1579)
     High grade peptide:    NO
     Groups included: 14,89

Sequence 9:      FSYQ(EQ)QPFPQQ (SEQ ID NO: 1580)

Optimal responding peptide: PQQSFSYQQQPFPQQPYPQQ (SEQ ID NO: 1581)
     High grade peptide:    NO
     Groups included: 15,96PT Sequence 10:     FPS(QE)(LQ)PY(LM)Q (SEQ ID NO: 1582)
     Optimal responding peptide: PFPSQQPYLQLQPFPQPQLP (SEQ ID NO: 1583)
     High grade peptide:    NO
     Groups included: 16PT,35,38,71PT, 76PT,92PT,93PT Sequence 11:     (PQSH)QP(QE)Q(QE)(LF)(PS)Q (SEQ ID NO: 1584)
     Optimal responding peptide: QQPQQPFPQQPQQQFPQPQQ (SEQ ID NO: 1585)
     High grade peptide:    GFFPQPEQEFPQPQQG (SEQ ID NO: 1586)
```

FIG. 6A

Groups included: 17,25,36,40,41,80,88

Sequence 12:      P(FW)(SP)(EQ)Q(EQT)QP(VILSF) (SEQ ID NO: 1587)
    Optimal responding peptide:    QQQQPPFSQQQQPVLPQQSP (SEQ ID NO: 1588)
(similar to but more active than PFSQQQSF in WO 02/083722)
        PSGQVQWPQQQQPFPQPQQP (SEQ ID NO: 1589)
    High grade peptide: GQPPFSEQEQPVLPQG (SEQ ID NO: 1590)
    Groups included: 18,79,84PT,97,102PT,103PT,115

Sequence 13:      (IL)QP(QE)QPFPQ (SEQ ID NO: 1591)
    Optimal responding peptide:    FTQPQQPTPIQPQQPFPQP (SEQ ID NO: 1592)
(similar to but more active than IIQPQQPAQ in WO 02/083722)
    High grade peptide:   GQQQFIQPEQPFPQQG (SEQ ID NO: 1593)
    Groups included: 19 (PART),26,30,58

Sequence 14:      QQP(EQ)LPFPQ (SEQ ID NO: 1594)
    Optimal responding peptide:   QQPQQPFPQPQQPQLPFPQQ (SEQ ID NO: 1595)
    High grade peptide:    NO
    Groups included: 21,64

Sequence 15:      QPQQP(EQ)LPF (SEQ ID NO: 1596)
    Optimal responding peptide:   QQPQQPFPQPQQPQLPFPQQ (SEQ ID NO: 1597)
    High grade peptide:    NO
    Groups included: 21

Sequence 16:      PQP(EQ)QP(EQ)LP (SEQ ID NO: 1598)
    Optimal responding peptide:   QQPQQPFPQPQQPQLPFPQQ (SEQ ID NO: 1599)
    High grade peptide:    NO
    Groups included: 21

Sequence 17:      VFLQQQCSPV (SEQ ID NO: 1600)
    Optimal responding peptides:
    GROUP 28:     SVLQQLNPCKVFLQQQCSHV (SEQ ID NO: 1601)
    GROUP 122:        CKVFLQQQCSPVAMPQRLAR (SEQ ID NO: 1602)
    GROUP 114:        KVFLQQQCSPVAIPYRLARS (SEQ ID NO: 1603)
    High grade peptide:    NO
    Groups included: 28,114,122

Sequence 18:      (M)(WL)(QW)QSSCHVMQ (SEQ ID NO: 1604)
    Optimal responding peptides:
    GROUP 39:       PQRLARSQMWQQSSCHVMQQ (SEQ ID NO: 1605)
    GROUP 110:      ARSQTLWQSSCHVMQQCCR (SEQ ID NO: 1606)
    High grade peptide:    NO
    Groups included: 39,110

Sequence 19:      QPQQQQLAH (SEQ ID NO: 1607)
    Optimal responding peptide: QQPQQQQLAHGTFLQPHQIA (SEQ ID NO: 1608)
    High grade peptide:    NO
    Groups included: 31

Sequence 20:      FPLQPQQP(FL)PQ (SEQ ID NO: 1609)
    Optimal responding peptide: PQQLQQPFPLQPQQPFPQQP (SEQ ID NO: 1610)
    High grade peptide:    NO
    Groups included: 33

Sequence 21:      FPP(QE)(LQ)PYPQ (SEQ ID NO: 1611)
    Optimal responding peptide: PQPFPPELPYPQPQPFPQQ (SEQ ID NO: 1612)
    High grade peptide: PQPQPFPPQLPYPQPQS, (SEQ ID NO: 1613)
    GQQQPFPPEQPYPQG (SEQ ID NO: 1614)
    Groups included: 37,52,71,92PT,93PT,105

FIG. 6B

```
Sequence 22:     LCC(QE)(HQR)L(PW)(QE)IP (SEQ ID NO: 1615)
     Optimal responding peptide: QSTYQPLQQLCCQQLWQIPE       (SEQ ID NO:
1616)
     High grade peptide:     NO
     Groups included: 39PT,100,104,107,178

Sequence 23:     P(WLS)(QL)(QE)QPL(PQ)(PQ) (SEQ ID NO: 1617)
     Optimal responding peptide: ERPWQEQPLPPQHTLFPQQQ (SEQ ID NO: 1618)
     High grade peptide:     NO
     Groups included: 44,78,90,95PT,98,116,117,113

Sequence 24:     QPLP(QE)QPSF (SEQ ID NO: 1619)
     Optimal responding peptide: PPFSQQQQQPLPQQPSFSQQ (SEQ ID NO: 1620)
     High grade peptide:     NO
     Groups included: 45,95PT Sequence 25:     PF(SP)QQQQQP(LVI) (SEQ ID NO: 1621)
     Optimal responding peptide: PPFSQQQQQPLPQQPSFSQQ (SEQ ID NO: 1622)
     High grade peptide:     NO
     Groups included: 45 PART Sequence 26:     IVYSTILQE (SEQ ID NO: 1623)
     Optimal responding peptide: QQSRYEAIRAIVYSTILQEQ (SEQ ID NO: 1624)
     High grade peptide:     NO
     Groups included: 46

Sequence 27:     PFSQ(QE)QP(IS)(LF)S (SEQ ID NO: 1625)
     Optimal responding peptide: FSQQQPFSQQQPILSQQPP (SEQ ID NO: 1626)
     High grade peptide:     NO
     Groups included: 47 PART,68

Sequence 28:     QGIQILRPL (SEQ ID NO: 1627)
     Optimal responding peptide: QEQQQGIQILRPLFQLVQGQ (SEQ ID NO: 1628)
     High grade peptide:     NO
     Groups included: 48

Sequence 29:     PFSSVVAGI (SEQ ID NO: 1629)
     Optimal responding peptide: CSIIKAPFSSVVAGIGGQYR (SEQ ID NO: 1630)
     High grade peptide:     NO
     Groups included: 49

Sequence 30:     YCSTTIAPV (SEQ ID NO: 1631)
     Optimal responding peptide: YIPPYCSTTIAPVGIFGTN (SEQ ID NO: 1632)
     High grade peptide:     NO
     Groups included: 50

Sequence 31:     HVAMSQRLA (SEQ ID NO: 1633)
     Optimal responding peptides: QQCSHVAMSQRLARSQMWQQ (SEQ ID NO: 1634)
     High grade peptide:     NO
     Groups included: 51

Sequence 32:     YSIILQ(QE)(QE)(QE)QGF (SEQ ID NO: 1635)
     Optimal responding peptide: RYDAICAITYSIILQEQQQG (SEQ ID NO: 1636)
     High grade peptide:     NO
     Groups included: 53

Sequence 33:     FPHQPQEQAFPQ (SEQ ID NO: 1637)
     Optimal responding peptide: QQIFPQPQQTFPHQPQQAFP (SEQ ID NO: 1638)
     High grade peptide:     GQTFPHQPEQAFPQPG (SEQ ID NO: 1639)
     Groups included: 67
```

FIG. 6C

```
Sequence 34:    PS(GS)(QE)V(QE)WPQ (SEQ ID NO: 1640)
    Optimal responding peptide: ATANMQADPSGQVQWPQQQP (SEQ ID NO: 1641)
    High grade peptide:    NO
    Groups included: 81,102PT Sequence 35:    GALCSSLSN (SEQ ID NO: 1642)
    Optimal responding peptide: FDEEKNSTGALCSSLSNQAS (SEQ ID NO: 1643)
    High grade peptide:    NO
    Groups included: 82

Sequence 36:    QFP(QE)Q(QE)IPV (SEQ ID NO: 1644)
    Optimal responding peptide: QPPFPQQHQQFPQQQIPVVQ (SEQ ID NO: 1645)
    High grade peptide:    NO
    Groups included: 83

Sequence 37:    P(FY)P(QE)QP(YF)PQ (SEQ ID NO: 1646)
    Optimal responding peptide: QQPFPQQPYPQQPYPSQQPY (SEQ ID NO: 1647)
    High grade peptide:    NO
    Groups included: 96

Sequence 38:    QAGQG(QE)(QE)GY (SEQ ID NO: 1648)
    Optimal responding peptide: GQQAGQGQQGYYPTSPQQLG (SEQ ID NO: 1649)
    High grade peptide:    NO
    Groups included: 101

Sequence 39:    TLPSMCNVY (SEQ ID NO: 1650)
    Optimal responding peptide: FEEIRNLALQTLPSMCNVYI (SEQ ID NO: 1651)
    High grade peptide:    NO
    Groups included: 106

Sequence 40:    FQPSQ(QE)NPQ (SEQ ID NO: 1652)
    Optimal responding peptide: QQYPSGQGFFQPSQQNPQAQ (SEQ ID NO: 1653)
    High grade peptide:    NO
    Groups included: 109

Sequence 41:    IRSLVLKTL (SEQ ID NO: 1654)
    Optimal responding peptide: QPQQPAQLEGIRSLVLKTLP (SEQ ID NO: 1655)
    High grade peptide:    NO
    Groups included: 119,120,121
```

FIG. 6D

| Gliadin Sequence | SEQ ID NO: | High quality peptide | A | B | C | D | E | F | G | H | I | J |
|---|---|---|---|---|---|---|---|---|---|---|---|---|
| 1,2 | 1656 | QLQPFPQPQLPYPQPQP | Y | Y | Y | Y | Y | Y | Y | Y | Y | Y |
| 3,4 | 1657 | GQQPFPQPEQPFPWQG | Y | Y | Y | Y | Y | Y | Y | Y | Y | Y |
| 3,4 | 1658 | GQQPFPQPEQPIPVQG | Y | Y | Y | Y | Y | Y | Y | Y | Y | Y |
| 3,4 | 1659 | GQQPFPQPEQPFPWQG | Y | Y | Y | Y | Y | Y | Y | Y | Y | Y |
| 5 | 1660 | GFPQTQQPEQPFPQQG |  | Y | Y |  |  |  | Y | Y |  | Y |
| 5 | 1661 | GFPQTQQPEQPFPQQG |  | Y | Y |  |  |  | Y | Y |  | Y |
| 6 | 1662 | GQPFPEQPQQPFPQQG |  |  |  |  |  |  |  | Y |  |  |
| 7 | 1663 | PQPQPFLPQLPYPQPQS | Y | Y | Y | Y | Y | Y | Y | Y | Y | Y |
| 11 | 1664 | GFFPQPEQEFPQPQQG |  | Y | Y | Y | Y |  | Y |  |  | Y |
| 11 | 1665 | GFFPQPEQEFPQPQQG |  | Y | Y | Y | Y |  | Y |  |  | Y |
| 12 | 1666 | GQPPFSEQEQPVLPQG |  |  |  |  | Y |  | Y |  | Y |  |
| 12 | 1667 | GQPPFSEQEQPVLPQG |  |  |  |  | Y |  | Y |  | Y |  |
| 13 | 1668 | GQQQFIQPEQPFPQQG |  | Y | Y |  | Y | Y | Y |  |  | Y |
| 21 | 1669 | PQPQPFPPQLPYPQPQS | Y | Y | Y | Y | Y | Y | Y | Y | Y | Y |
| 21 | 1670 | GQQQPFPPEQPYPQQG |  | Y | Y |  |  |  |  |  | Y | Y |
| 33 | 1671 | GQTFPHQPEQAFPQPG |  | Y | Y |  |  |  | Y |  | Y | Y |

FIG. 7

| Avenin 20mer | SEQ ID NO: | Predicted core sequence(s) | SEQ ID NO: | Lambda | Proportion |
|---|---|---|---|---|---|
| TTTVQYDPSEQYQPYPEQQQ | 1672 | DPSEQYQPY | 1684 | 33.58 | 0.145 |
| QFDPSEQYQPYPEQQQPILQ | 1673 | PYPEQQQPI<br>DPSEQYQPYP | 1685<br>1686 | 122.34 | 0.103 |
| *VQYDPSEQYQPYPEQQQPFV | 1674 | PYPEQQQPF<br>DPSEQYQPYP | 1687<br>1688 | 122.34 | 0.105 |
| TVQYNPSEQYQPYPEQQEPF | 1675 | PYPEQQEPF<br>DPSEQYQPYP | 1689<br>1690 | 146.42 | 0.051 |
| YQPYPEQQQPILQQQQMLLQ | 1676 | PYPEQQQPI | 1691 | 52.56 | 0.126 |
| EQYQPYPEQQQPFVQQQPFF | 1677 | PYPEQQQPF | 1692 | 90.39 | 0.053 |
| SEQYQPYPEQQPFMQPLLQQ | 1678 | PYPEQQPFM | 1693 | 19.07 | 0.226 |
| *CRRLEQIPEQLRCPAIHSVV | 1679 | RRLEQIPEQ | 1694 | 61.47 | 0.069 |
| *QIPEQLRCPAIHSVVQAIIL | 1680 | | | 94.84 | 0.033 |
| *NNKREQQFGQNIFSGFSVQL | 1681 | | | 104.78 | 0.077 |
| *QILRQAICQVTRQQCCRQLA | 1682 | | | 34.01 | 0.055 |
| *VPFLRSQILRQSTCHVMRRQ | 1683 | | | 92.47 | 0.067 |

```
Sequence  1:       PYPEQ(QE)QP(IF)(VLM)  (SEQ ID NO:1695)
     Optimal responding peptide: QFDPSEQYQPYPEQQQPILQ (SEQ ID NO:1696)
     High grade peptide:    NO
     POTENCY:  6/30 RESPONDERS, RESPONSE RATE 122.3
(HOMOLOGOUS TO WHEAT Sequence 12: GQPPFSEQEQPVLPQG (SEQ ID NO:1590))

Sequence  2:       CRRLEQIPEQLRCPAIHSVV (SEQ ID NO:1697)

Sequence  3:       QFGQNIFSGFSVQLLSEALG (SEQ ID NO:1698)
     POTENCY:  12/30 RESPONDERS, RESPONSE RATE 11.2
```

FIG. 8

| Group | Predicted epitope "core(s)" | SEQ ID NO: | Sequences | SEQ ID NO: | Response (SFC) A | Response (SFC) B |
|---|---|---|---|---|---|---|
| 1 | QQPTPIQPQ | 1699 | PFTQPQQPTPIQPQQPFPQQ | 1722 | 70 | 18 |
| 2 | QQPFPQQPQ or QQPFPWQPQ or QQPFPQSQQ | 1700 1701 1702 | QQQFIQPQQPFPQQPQQTYP | 1723 | 57 | 21 |
| | | | PFPQQPQQPFPQQPQQSFPQ | 1724 | 53 | 23 |
| | | | TPIQPQQPFPQQPQQPQQPF | 1725 | 64 | 16 |
| | | | QTQQPQQPFPQQPQQPFPQT | 1726 | 52 | 17 |
| | | | QQPFLQPQQPFPQQPQQPYPQ | 1727 | 44 | 16 |
| | | | PQQPFPQQPQQPQQPFPQPQ | 1728 | 51 | 14 |
| | | | QQPFPQQPQQPFPQPQQPIP | 1729 | 81 | 10 |
| | | | PQQPFLQPQQPFPQQPQQPF | 1730 | 45 | 9 |
| | | | QPFPQPQQPFPWQPQQPFPQ | 1731 | 19 | 8 |
| | | | QPQQPFPQSQQPQQPFPQPQ | 1732 | 41 | 15 |
| | | | PQTQQPQQPFPQSQQPQQPF | 1733 | 36 | 9 |
| 3 | QQPFPLQPQ or QQPFPQLQQ | 1703 1704 | SEQIIPQQLQQPFPLQPQQP | 1734 | 12 | 3 |
| | | | PFPQTQQPQQPFPQLQQPQQ | 1735 | 25 | 13 |
| 4 | QQPIPVQPQ or QQPIPQQPQ or QQPYPQQPQ | 1705 1706 1707 | QPQQPIPVQPQQSFPQQSQQ | 1736 | 60 | 12 |
| | | | FPELQQPIPQQPQQPFPLQP | 1737 | 22 | 7 |
| | | | FPQQPQQPYPQQPQQPFPQT | 1738 | 19 | 4 |
| | | | PRQPFPQQPQQPYPQQPQQP | 1739 | 19 | 13 |
| 5 | PQQPQQSFPQQQ or PQQPQQPFPQQQ | 1708 1709 | PFPQPQQPQQSFPQQQQPLI | 1740 | 29 | 15 |
| | | | LPQPQQPQQSFPQQQRPFIQ | 1741 | 37 | 12 |
| | | | QPQQPQQPFPQQQQPLIQPY | 1742 | 49 | 17 |
| 6 | QGSFQPSQQ | 1710 | QPQQQYPSGQGSFQPSQQNP | 1743 | 54 | 5 |
| | | | QYPSSQGSFQPSQQNPQAQG | 1744 | 32 | 7 |
| | | | GQGFFQPSQQNPQAQGSFQP | 1745 | 7 | 3 |
| 7 | PQQPFPQPQQ or PQQPFPQTQQ | 1711 1712 | PQTQQPQQPFPQPQQTFPQQ | 1746 | 21 | 9 |
| | | | QQPQQPFPQPQLPFFQQSEQ | 1747 | 15 | 2 |
| | | | FPWQPQQPFPQTQQSFPLQP | 1748 | 25 | 7 |
| 8 | QQPQQPFPQ or QQPQQPYPQ | 1713 1714 | PFPQTQQPQQPFPQLQQPQQ | 1749 | 25 | 13 |
| | | | QQPLPQPQQPQQPFPQSQQP | 1750 | 54 | 20 |
| | | | PFPQLQQPQQPFPQPQQQLP | 1751 | 36 | 5 |
| | | | PRQPFPQQPQQPYPQQPQQP | 1752 | 19 | 13 |
| 9 | PFPQPQQPQ or PFPQSQQPQ or PFPQPQQAQ or QFPQTQQPQ | 1715 1716 1717 1718 | PQQPFPQPQQPQQPFPQLQQ | 1753 | 37 | 8 |
| | | | PQTQQPQQPFPQSQQPQQPF | 1754 | 36 | 9 |
| | | | QPQQPFPQSQQPQQPFPQPQ | 1755 | 41 | 15 |
| | | | PQQPQQPFPQPQQAQLPFPQ | 1756 | 16 | 7 |
| | | | HQPQQQFPQTQQPQQPFPQP | 1757 | 30 | 14 |
| 10 | PQQQFIQPQ | 1719 | FSQPQQPQQQFIQPQQPFPQ | 1758 | 45 | 8 |
| 11 | QQPQLPFPQ or LQPQQPFPQ | 1720 1721 | PQPQQPQLPFPQQPQQPFPQ | 1759 | 79 | 7 |
| | | | PQQQFLQPQQPFPQQPRQPY | 1760 | 35 | 14 |
| 12 | | | QTLPAMCNVYIPPHCSTTIA | 1761 | 35 | 7 |
| 13 | | | NPSQQPQEQVPLVQEQQFQ | 1762 | 5 | 16 |
| 14 | | | HHFESNSNHHFHSNNQFYR | 1763 | 14 | 3 |

FIG. 9

```
VRVPVPQLQP  QNPSQQQPQE  QVPLVQQQQF  PGQQQQFPPQ
QPYPQPQPFP  SQQPYLQLQP  FPQPQLPYPQ  PQSFPPQQPY
PQPQPQYSQP  QQPISQQQAQ  QQQQQQQQQQ  QQQILQQILQ
QQLIPCMDVV  LQQHNIAHAR  SQVLQQSTYQ  LLQELCCQHL
WQIPEQSQCQ  AIHNVVHAII  LHQQQKQQQQ  PSSQVSFQQP
LQQYPLGQGS  FRPSQQNPQA  QGSVQPQQLP  QFEEIRNLAL
QTLPAMCNVY  IAPYCTIAPF  GIFGTN
```

FIG. 10

EPITOPES RELATED TO COELIAC DISEASE

RELATED APPLICATIONS

This application is a divisional of U.S. application Ser. No. 13/541,864, filed Jul. 5, 2012, which is a continuation of U.S. application Ser. No. 11/568,428, filed Jul. 9, 2008 and now abandoned, which is a national stage entry of International Application PCT/GB05/01621, filed Apr. 28, 2005, which claims benefit of Australian application number 2005900650, filed Feb. 11, 2005 and Australian application number 2004201774, filed Apr. 28, 2004.

SEQUENCE LISTING

The instant application contains a Sequence Listing which has been submitted electronically in ASCII format and is hereby incorporated by reference in its entirety. Said ASCII copy, created on Apr. 30, 2018, is named 500028US03_SL.txt and is 643,248 bytes in size.

BACKGROUND

The invention relates to epitopes useful in the diagnosis and therapy of coeliac disease, including diagnostics, therapeutics, kits, and methods of using the foregoing.

Coeliac disease is caused by an immune mediated hypersensitivity to dietary gluten. Gluten proteins in wheat, rye, barley and in some cases oats are toxic in coeliac disease. Gluten is composed of alpha/beta, gamma and omega gliadins, and low and high molecular weight (LMW and HMW) glutenins in wheat, hordeins in barley, secalins in rye and avenins in oats. Hordeins and secalins are homologous to gamma and omega gliadins and low and high molecular weight glutenins in wheat. Avenins are phylogenetically more distant than hordeins and secalins from wheat gluten.

The goal of research in coeliac disease has been to define the toxic components of gluten by defining the peptides that stimulate gluten-specific T-cells. Precise definition of gluten epitopes permits development of new diagnostics, therapeutics, tests for gluten contamination in food and non-toxic grains that retain the cooking/baking qualities of traditional gluten. Many of these applications require a comprehensive understanding of all rather than the most common toxic peptides in gluten.

Genes encoding HLA-DQ2 and/or HLA-DQ8 are present in over 99% of individuals with coeliac disease compared to approximately 35% of the general Caucasian population. Gluten-derived peptides (epitopes) bound to HLA-DQ2 or HLA-DQ8 stimulate specific T-cells. HLA-DQ2 and DQ8-restricted epitopes include a "core" 9 amino acid sequence that directly interacts with the peptide binding groove of HLA-DQ2 or DQ8 and with cognate T-cell receptors. In general, libraries of overlapping peptides (usually 15 to 20mers) containing all unique 10 or 12mer peptides in an antigen have been used to map HLA class II-restricted T-cells epitopes.

A series of gluten peptides are known to activate gluten specific T-cells in coeliac disease. Previous studies have identified gluten peptides from selected gluten proteins or gluten digests. T-cell clones and lines isolated from intestinal biopsies have been used to screen these gluten components.

Modification of gluten by the enzyme, tissue transglutaminase (tTG) present in intestinal tissue, substantially increases gluten's stimulatory capacity on gluten specific T-cells. Most of the known epitopes for gluten-specific T-cells correspond to tTG-deamidated gluten peptides. Transglutaminase mediates deamidation of specific glutamine residues (to glutamate) in gluten. Glutamine-containing sequences susceptible to deamidation by tTG generally conform to a motif: QXPX (SEQ ID NO: 1929) or QXX (FYMILVW) (SEQ ID NO: 1942) (see Vader W. et al 2002 *J. Exp. Med.* 195:643-649, PCT WO 03/066079, and Fleckenstein B. 2002. J Biol Chem 277:34109-16). The motif for peptides that bind to HLA-DQ2 and that are susceptible to deamidation by tTG has been used to predict certain gluten epitopes (Vader et al J Exp Med 2002 *J. Exp. Med.* 195: 643-649, PCT WO 03/066079).

However, other groups have identified epitopes for gluten-specific intestinal T-cell clones and lines using panels of eleven recombinant alpha/beta (11) and five gamma gliadins (Arentz-Hansen H. 2000. *J. Exp. Med.* 191:603-612, Arentz-Hansen H. 2002. *Gastroenterology* 123:803-809, PCT WO 02/083722), and lysates of purified gluten proteins (Sjostrom H. et al 1998. *Scand. J. Immunol.* 48, 111-115; van de Wal, Y. et al 1998. *J. Immunol.* 161(4):1585-1588; van de Wal, Y. et al 1999. *Eur. J. Immunol.* 29:3133-3139; Vader W. et al 2002. *Gastroenterology* 122:1729-1737.).

Our work has exploited the observation that gluten challenge in vivo induces HLA-DQ2 restricted CD4+ gluten-specific T-cells in peripheral blood expressing a gut-homing integrin (alpha4beta7). This technique allowed the mapping of the dominant epitope in A-gliadin (57-73 QE65) (Anderson, R P et al 2000. *Nat. Med.* 6:337-342, WO 01/25793). A-gliadin 57-73 QE65 corresponds to two overlapping epitopes identified using intestinal T-cell clones (Arentz-Hansen H. et al 2000. *J. Exp. Med.* 191:603-612, Arentz-Hansen H. et al 2002. *Gastroenterology* 123:803-809). The advantage of in vivo gluten challenge to induce gluten specific T-cells is that any food can be consumed and the resulting T-cells induced in blood (quantified in peripheral blood using a simple overnight interferon gamma ELISPOT assay) will have been stimulated in vivo by endogenously presented epitopes, rather than primed in vitro by a synthetic or purified antigen. Overnight assays of fresh polyclonal peripheral blood T-cells also avoid the potential for artefacts associated with the lengthy purification of T-cell clones.

Interestingly, T-cell clones and lines specific for several gamma-gliadin epitopes (Arentz-Hansen H. 2002. *Gastroenterology* 123:803-809, PCT WO 02/083722) cross-react with the originally defined A-gliadin epitope 57-73 QE65.

Although there is substantial homology within the alpha/beta gliadins, earlier work (see WO 03/104273) has shown that the dominant epitope recognized in HLA-DQ2-associated coeliac disease, "A-gliadin 57-73 QE65", is encoded by a minority of the alpha/beta gliadins present in Genbank.

SUMMARY OF THE INVENTION

The current study set out to develop a method that would allow mapping of all T-cell epitopes in gluten. Consumption of wheat bread (200 g daily for 3 days) or oats (100 g daily for 3 days) was used to induce gluten or avenin-specific T-cells in peripheral blood (collected 6 days after beginning the challenge). Peripheral blood mononuclear cells (PBMC) were assessed in overnight interferon gamma ELISPOT assays using a library of gluten and avenin peptides including all unique 12mer sequences included in every Genbank entry for wheat gluten and/or oat avenins. This goal was achieved by establishing an algorithm to design peptides spanning all potential epitopes in gluten proteins in Genbank (2922 20mers included all 14 964 unique 9mers—potential T-cell epitopes), adapting the interferon-gamma ELISPOT assay to a high throughput assay capable of screening over 1000 peptides with a single individual's blood and developing bioinformatics tools to analyse and interpret the data generated.

A series of 41 "superfamilies" of wheat gluten peptides were identified as putative T-cell epitopes. Superfamilies shared motifs in which a limited level of redundancy was allowed. Many of the most potent families include known T-cell epitopes including the previously described dominant epitope, A-gliadin 57-73.

Through comprehensive mapping of gluten epitopes using PBMC after gluten challenge, the inventors have found a series of novel gliadin, LMW and HMW glutenin, and avenin epitopes for coeliac disease associated with HLA-DQ2 and HLA-DQ8. Novel epitopes were identified for HLA-DQ2 and HLA-DQ8-associated coeliac disease. HLA-DQ2 and HLA-DQ8 associated coeliac disease are genetically and functionally distinct in terms of the range of T-cell epitopes that are recognized. In addition, three peptides present in avenin proteins of oats also activated peripheral blood mononuclear cells (PBMC) following oats challenge in HLA-DQ2+ coeliac subjects, the first time oats epitopes have been defined. Identification of avenin peptides recognized by T-cells following oats challenge in vivo provides a molecular basis for the observed occasional relapse of coeliacs following oat exposure (Lundin K E A et al. 2003 Gut 52:1649-52) and may provide a basis for a predictive diagnostic or genetic de-toxification of oats.

The data presented here will provide a comprehensive basis for definition of both common "dominant" and occasional "weak" T-cell epitopes in coeliac disease. This information is the platform for functional applications such as diagnostics, food tests, immunotherapeutics and prophylactics, and for design of non-toxic gluten proteins useful in modified grains.

In particular, through comprehensive mapping of gluten T cell epitopes, the inventors have found epitopes bioactive in coeliac disease in HLA-DQ2+ patients in wheat gliadins and glutenins, having similar core sequences (e.g., SEQ ID NOS: 1-199) and similar extended sequences (e.g., SEQ ID NOS:200-1554, 1555-1655, 1656-1671, and 1830-1903). The inventors have also found epitopes bioactive in coeliac disease in HLA-DQ2+ patients in: oat avenins having similar core sequences (e.g., SEQ ID NOS: 1684-1695) and similar extended sequences (e.g., SEQ ID NO: 1672-1683, 1696-1698, and 1764-1768); rye secalins (SEQ ID NOS: 1769-1786); and barley hordeins (SEQ ID NOS: 1787-1829). Additionally, epitopes bioactive in coeliac disease in HLA-DQ8+ patients have been identified in wheat gliadins having similar core sequences (e.g., SEQ ID NOS: 1699-1721) and similar extended sequences (e.g., SEQ ID NOS: 1722-1763 and 1908-1927). This comprehensive mapping thus provides dominant epitopes recognized by T cells in coeliac patients. Thus, the methods of the invention described herein may be performed using any of these identified epitopes, and analogues and equivalents thereof. That is, the agents of the invention include these epitopes. Additionally, combinations of epitopes, i.e., "combitopes" or single peptides comprising two or more epitopes, have been shown to induce equivalent responses as the individual epitopes, indicating that several epitopes may be utilized for therapeutic, diagnostic, and other uses of the invention. Such combitopes may be in the form of, e.g., SEQ ID NO: 1906. Preferably, the agents of the invention include one or more of the epitopes having the sequences listed recited in SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927 and analogues and equivalents thereof as defined herein.

Preferred agents that are bioactive in coeliac disease in HLA-DQ8+ patients possess a glutamine in a sequence that suggests susceptibility to deamidation separated by seven residues from a second glutamine also susceptible to deamidation (e.g., as found in QGSFQPSQQ (SEQ ID NO: 1710)) wherein the deamidated sequences are high affinity binders for HLA-DQ8 following deamidation by tTG (The binding motif for HLA-DQ8 favours glutamate at positions 1 and 9.) In a less preferred embodiment, the agent possesses glutamine residues susceptible to deamidation but not separated by seven residues from a second glutamine susceptible to tTG-mediated deamidation.

The invention thus provides a method of diagnosing coeliac disease, or susceptibility to coeliac disease, in an individual, comprising the steps of: (a) contacting a sample from the host with an agent selected from (i) the epitope comprising an amino acid sequence selected from SEQ ID NOS: 1-1927, preferably selected from SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927, or an equivalent sequence from a naturally occurring gluten protein, (ii) an analogue of (i) which is capable of being recognised by a T cell receptor that recognises (i), which in the case of a peptide analogue is not more than 50 amino acids in length, or (iii) a product comprising two or more agents as defined in (i) or (ii); and (b) determining in vitro whether T cells in the sample recognise the agent, with recognition by the T cells indicating that the individual has, or is susceptible to, coeliac disease.

The term "gluten protein" encompasses alpha/beta, gamma and omega gliadins, and low and high molecular weight (LMW and HMW) glutenins in wheat, hordeins in barley, secalins in rye, and avenins in oats. The invention is particularly concerned with gliadins and avenins.

The invention also provides use of the agent for the preparation of a diagnostic means for use in a method of diagnosing coeliac disease, or susceptibility to coeliac disease, in an individual, said method comprising determining whether T cells of the individual recognise the agent, recognition by the T cells indicating that the individual has, or is susceptible to, coeliac disease.

The finding of epitopes which are modified by transglutaminase also allows diagnosis of coeliac disease based on determining whether other types of immune response to these epitopes are present. Thus the invention also provides a method of diagnosing coeliac disease, or susceptibility to coeliac disease, in an individual comprising determining the presence of an antibody that binds to the epitope in a sample from the individual, the presence of the antibody indicating that the individual has, or is susceptible to, coeliac disease.

The invention provides a method of determining whether a composition is capable of causing coeliac disease comprising determining whether a protein capable of being modified by a transglutaminase to an oligopeptide sequence as defined above is present in the composition, the presence of the protein indicating that the composition is capable of causing coeliac disease.

The invention also provides a mutant gluten protein whose wild-type sequence can be modified by a transglutaminase to a sequence that comprises an epitope comprising sequence as defined above, but which mutant gluten protein has been modified in such a way that it does not contain sequence which can be modified by a transglutaminase to a sequence that comprises such an epitope comprising sequence; or a fragment of such a mutant gluten protein which is at least 7 amino acids long (e.g., at least 7, 8, 9, 10, 11, 12, 13, 14 or 15 amino acids long) and which comprises sequence which has been modified in said way.

The invention also provides a protein that comprises a sequence which is able to bind to a T cell receptor, which T cell receptor recognises the agent, and which sequence is able to cause antagonism of a T cell that carries such a T cell receptor.

Additionally the invention provides a food that comprises the proteins defined above.

The invention additionally provides the agent, optionally in association with a carrier, for use in a method of treating or preventing coeliac disease by tolerising T cells which recognise the agent. Also provided is an antagonist of a T cell which has a T cell receptor that recognises (i), optionally in association with a carrier, for use in a method of treating or preventing coeliac disease by antagonising such T cells. Additionally provided is the agent or an analogue that binds an antibody (that binds the agent) for use in a method of treating or preventing coeliac disease in an individual by tolerising the individual to prevent the production of such an antibody.

The invention also provides methods of preventing or treating coeliac disease comprising administering to an individual at least one agent selected from: a) a peptide comprising at least one epitope comprising a sequence selected from the group consisting of SEQ ID NOs: 1-1927, preferably from the group consisting of SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927, and equivalents thereof; and b) an analogue of a) which is capable of being recognised by a T cell receptor that recognises the peptide of a) and which is not more than 50 amino acids in length. In some embodiments, the agent is HLA-DQ2-restricted, HLA-DQ8-restricted or one agent is HLA-DQ2-restricted and a second agent is HLA-DQ8-restricted. In some embodiments, the agent comprises a wheat epitope, an oat epitope, a rye epitope, a barley epitope or any combination thereof either as a single agent or as multiple agents.

The present invention also provides methods of preventing or treating coeliac disease comprising administering to an individual a pharmaceutical composition comprising an agent as described above and pharmaceutically acceptable carrier or diluent.

The present invention also provides methods of preventing or treating coeliac disease comprising administering to an individual a pharmaceutical composition comprising an antagonist of a T cell which has a T cell receptor as defined above, and a pharmaceutically acceptable carrier or diluent.

The present invention also provides methods of preventing or treating coeliac disease comprising administering to an individual a composition for tolerising an individual to a gluten protein to suppress the production of a T cell or antibody response to an agent as defined above, which composition comprises an agent as defined above.

The present invention also provides methods of preventing or treating coeliac disease by 1) diagnosing coeliac disease in an individual by either: a) contacting a sample from the host with at least one agent selected from: i) a peptide comprising at least one epitope comprising a sequence selected from the group consisting of: SEQ ID NOS: 1-1927, preferably selected from the group consisting of SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927, and equivalents thereof; and ii) an analogue of i) which is capable of being recognised by a T cell receptor that recognises i) and which is not more than 50 amino acids in length; and determining in vitro whether T cells in the sample recognise the agent; recognition by the T cells indicating that the individual has, or is susceptible to, coeliac disease; or b) administering an agent as defined above and determining in vivo whether T cells in the individual recognise the agent, recognition of the agent indicating that the individual has or is susceptible to coeliac disease; and 2) administering to an individual diagnosed as having, or being susceptible to, coeliac disease a therapeutic agent for preventing or treating coeliac disease.

The present invention also provides agents as defined above, optionally in association with a carrier, for use in a method of treating or preventing coeliac disease by tolerising T cells which recognise the agent.

The present invention also provides antagonists of a T cell which has a T cell receptor as defined above, optionally in association with a carrier, for use in a method of treating or preventing coeliac disease by antagonising such T cells.

The present invention also provides proteins that comprises a sequence which is able to bind to a T cell receptor, which T cell receptor recognises an agent as defined above, and which sequence is able to cause antagonism of a T cell that carries such a T cell receptor.

The present invention also provides pharmaceutical compositions comprising an agent or antagonist as defined and a pharmaceutically acceptable carrier or diluent.

The present invention also provides compositions for tolerising an individual to a gluten protein to suppress the production of a T cell or antibody response to an agent as defined above, which composition comprises an agent as defined above.

The present invention also provides compositions for antagonising a T cell response to an agent as defined above, which composition comprises an antagonist as defined above.

The present invention also provides mutant gluten proteins whose wild-type sequence can be modified by a transglutaminase to a sequence which is an agent as defined above, which mutant gluten protein comprises a mutation which prevents its modification by a transglutaminase to a sequence which is an agent as defined above; or a fragment of such a mutant gluten protein which is at least 7 amino acids long (e.g., at least 7, 8, 9, 10, 11, 12, 13, 14 or 15 amino acids long) and which comprises the mutation.

The present invention also provides polynucleotides that comprise a coding sequence that encodes a protein or fragment as defined above.

The present invention also provides cells comprising a polynucleotide as defined above or which have been transformed with such a polynucleotide.

The present invention also provides mammals that expresses a T cell receptor as defined above.

The present invention also provides methods of diagnosing coeliac disease, or susceptibility to coeliac disease, in an individual comprising: a) contacting a sample from the host with at least one agent selected from i) a peptide comprising at least one epitope comprising a sequence selected from the group consisting of: SEQ ID NOS: 1-1927, preferably selected from the group consisting of SEQ ID NOS: SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927, and equivalents thereof; and ii) an analogue of i) which is capable of being recognised by a T cell receptor that recognises i) and which is not more than 50 amino acids in length; and b) determining in vitro whether T cells in the sample recognise the agent; recognition by the T cells indicating that the individual has, or is susceptible to, coeliac disease.

The present invention also provides methods of determining whether a composition is capable of causing coeliac disease comprising determining whether a protein capable of being modified by a transglutaminase to an oligopeptide sequence is present in the composition, the presence of the protein indicating that the composition is capable of causing coeliac disease.

The present invention also provides methods of identifying an antagonist of a T cell, which T cell recognises an agent as defined above, comprising contacting a candidate substance with the T cell and detecting whether the substance causes a decrease in the ability of the T cell to undergo an antigen specific response, the detecting of any such decrease in said ability indicating that the substance is an antagonist.

The present invention also provides kits for carrying out any of the methods described above comprising an agent as defined above and a means to detect the recognition of the peptide by the T cell.

The present invention also provides methods of identifying a product which is therapeutic for coeliac disease comprising administering a candidate substance to a mammal as defined above which has, or which is susceptible to, coeliac disease and determining whether substance prevents or treats coeliac disease in the mammal, the prevention or treatment of coeliac disease indicating that the substance is a therapeutic product.

The present invention also provides processes for the production of a protein encoded by a coding sequence as defined above which process comprises: a) cultivating a cell described above under conditions that allow the expression of the protein; and optionally b) recovering the expressed protein.

The present invention also provides methods of obtaining a transgenic plant cell comprising transforming a plant cell with a vector as described above to give a transgenic plant cell.

The present invention also provides methods of obtaining a first-generation transgenic plant comprising regenerating a transgenic plant cell transformed with a vector as described above to give a transgenic plant.

The present invention also provides methods of obtaining a transgenic plant seed comprising obtaining a transgenic seed from a transgenic plant obtainable as described above.

The present invention also provides methods of obtaining a transgenic progeny plant comprising obtaining a second-generation transgenic progeny plant from a first-generation transgenic plant obtainable by a method as described above, and optionally obtaining transgenic plants of one or more further generations from the second-generation progeny plant thus obtained.

The present invention also provides transgenic plant cells, plants, plant seeds or progeny plants obtainable by any of the methods described above.

The present invention also provides transgenic plants or plant seeds comprising plant cells as described above.

The present invention also provides transgenic plant cell calluses comprising plant cells as described above obtainable from a transgenic plant cell, first-generation plant, plant seed or progeny as defined above.

The present invention also provides methods of obtaining a crop product comprising harvesting a crop product from a plant according to any method described above and optionally further processing the harvested product.

The present invention also provides food that comprises a protein as defined above.

BRIEF DESCRIPTION OF THE DRAWINGS

FIG. 2A and FIG. 2B show Genbank accession numbers for gluten gene products present in the Genbank database on 16 Jun. 2003 (see FIG. 2A and FIG. 2B).

FIG. 3A shows an expectation maximization (EM) algorithm to analyze data from ELISpot.

FIG. 3B shows a test on a dataset of patients with coeliac disease.

FIG. 5A, FIG. 5B, FIG. 5C, FIG. 5D, FIG. 5E, FIG. 5F, FIG. 5G, FIG. 5H, FIG. 5I, FIG. 5J, FIG. 5K, FIG. 5L, FIG. 5M, FIG. 5N, FIG. 5O, FIG. 5P, FIG. 5Q, FIG. 5R, FIG. 5S, FIG. 5T, FIG. 5U, FIG. 5W, FIG. 5V, FIG. 5X, FIG. 5Y, FIG. 5Z, and FIG. 5AA show gliadin and glutenin sequences (SEQ ID NOS: 1-1554). In the "consensus" column, letters in lower case use the standard one letter amino acid code, but letters in upper case have a different meaning: E=[e or q], F=[f or y or w], I=[i or l or v], S=[s or t], R=[r or k or h]. The "sequence" column uses the standard one letter amino acid code.

FIG. 6A, FIG. 6B, FIG. 6C, and FIG. 6D show gluten peptides that stimulate gamma interferon in PBMC collected 6 days after gluten challenge in HLA-DQ2+ coeliac disease volunteers (SEQ ID NOS: 1555-1655). The indicated 9mers are common to 200 groups of bioactive "structurally" related 20mer peptides. The gluten sequences are ranked according to the bioactivity×proportion of subjects responding.

FIG. 7 shows the results of a wheat challenge experiment (SEQ ID NOS: 1656-1671). These peptides gave high quality responses (indicated 'Y') in ten subjects (A-J) after wheat challenge.

FIG. 8 shows Avenin peptides (+/− deamidation by tTG) that stimulate interferon-γ in PBMC collected 6 days after gluten challenge in HLA-DQ2+ coeliac disease volunteers (SEQ ID NOS: 1672-1698). Those marked with a * are optimal unique 20mers inducing IFN-γ after oats challenge.

FIG. 9 shows the most potent 40 20mers (SEQ ID NOS: 1699-1763) in two HLA-DQ8 (not HLA-DQ2) subjects grouped according to shared core sequences. The core sequence of group 6 (QGSFQPSQQ (SEQ ID NO: 1710)) corresponds to the alpha-gliadin epitope described by van de Wal et al (*J. Immunol.* 1998, 161(4):1585-1588). The maximum response in Subject A was 271 SFC (medium alone, no peptide response: 4 SFC), and in B it was 26 SFC (medium alone, no peptide response: 1 SFC).

FIG. 10 shows the amino acid sequence of A-gliadin (SEQ ID NO: 1928) based on amino acid sequencing.

DETAILED DESCRIPTION OF THE INVENTION

Figure 1:
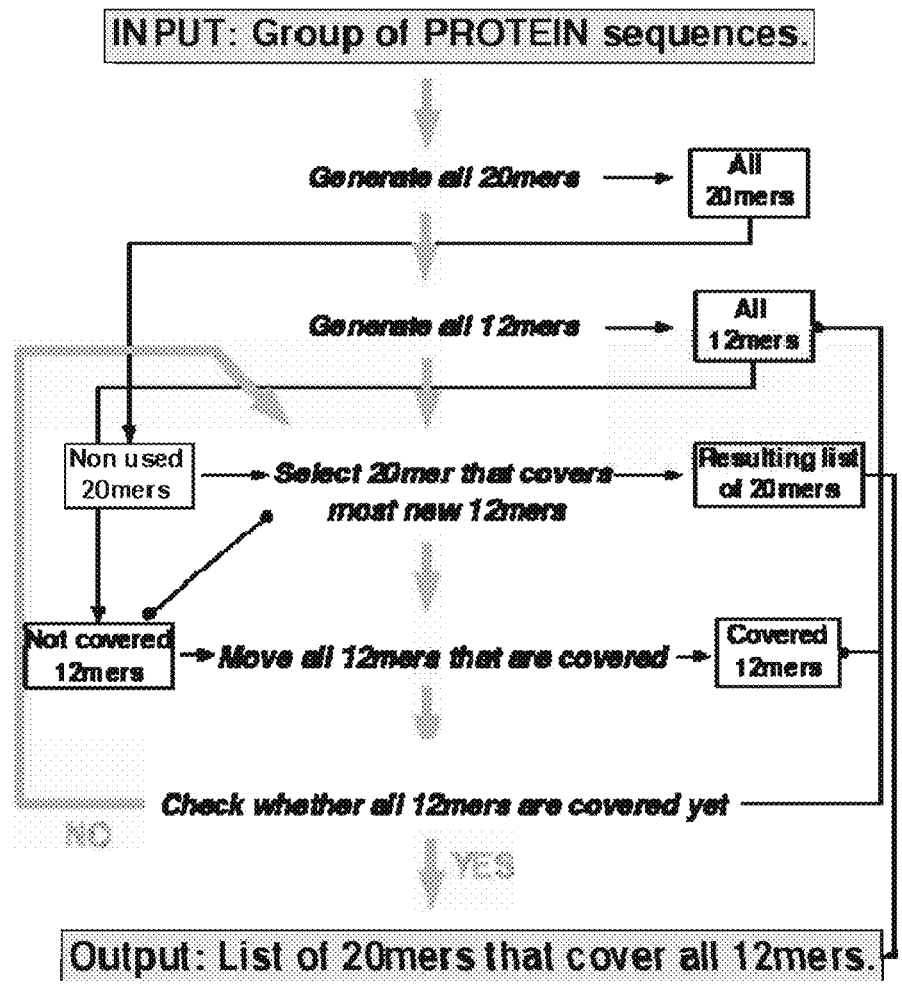
FIG. 1 shows a method to generate all possible peptide epitopes from a group of proteins.

The term "coeliac disease" encompasses a spectrum of conditions caused by varying degrees of gluten sensitivity, including a severe form characterised by a flat small intestinal mucosa (hyperplastic villous atrophy) and other forms characterised by milder symptoms.

The individual mentioned above (in the context of diagnosis or therapy) is human. They may have coeliac disease (symptomatic or asymptomatic) or be suspected of having it. They may be on a gluten free diet. They may be in an acute phase response (for example they may have coeliac disease, but have only ingested gluten in the last 24 hours before which they had been on a gluten free diet for 14 to 28 days).

The individual may be susceptible to coeliac disease, such as a genetic susceptibility (determined for example by the individual having relatives with coeliac disease or possessing genes which cause predisposition to coeliac disease).

The Agent

The agent is typically a peptide, for example of length 7 to 50 amino acids, such as 10 to 40, 12 to 35 or 15 to 30 amino acids in length.

The agent may be the peptide represented by any of SEQ ID NOS: 1-1927 or an epitope comprising sequence that comprises any of SEQ ID NOS: 1-1927 which is an isolated oligopeptide derived from a gluten protein; or an equivalent of these sequences from a naturally occurring gluten protein. In a further set of embodiments of the invention, the agent is any peptide epitope of an oat gluten (e.g. any T cell epitope of an avenin).

Preferably, the agent is the peptide represented by any of SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927 or an epitope comprising sequence that comprises any of SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927 which is an isolated oligopeptide derived from a gluten protein; or an equivalent of these sequences from a naturally occurring gluten protein.

Thus the epitope may be a derivative of a naturally occurring gluten protein, particularly from a wheat or oat gluten. Such a derivative is typically a fragment of the gluten protein, or a mutated derivative of the whole protein or fragment. Therefore the epitope of the invention does not include the naturally occurring whole gluten protein, and does not include other whole naturally occurring gluten proteins.

Typically such fragments will be at least 7 amino acids in length (e.g., at least 7, 8, 9, 10, 11, 12, 13, 14 or 15 amino acids in length).

Typically such fragments will be recognised by T cells to at least the same extent that the agents from which they are derived are recognised in any of the assays described herein using samples from coeliac disease patients.

The agent may be the peptide represented by any of SEQ ID NOS: 1-1927, preferably the peptide represented by any of SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927 or a protein comprising a sequence corresponding to any of SEQ ID NOS: 1-1927, preferably comprising a sequence corresponding to any of from SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927 (such as fragments of a gluten protein comprising any of SEQ ID NOS: 1-1927 and preferably any of from SEQ ID NOS: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927, for example after the gluten protein has been treated with transglutaminase). Bioactive fragments of such sequences are also agents of the invention. Typically such fragments will be at least 7 amino acids in length (e.g., at least 7, 8, 9, 10, 11, 12, 13, 14 or 15 amino acids in length). Sequences equivalent to any of SEQ ID NOS: 1-1927 or analogues of these sequences are also agents of the invention.

In the case where the epitope comprises a sequence equivalent to the above epitopes (including fragments) from another gluten protein (e.g. any of the gluten proteins mentioned herein or any gluten proteins which cause coeliac disease), such equivalent sequences will correspond to a fragment of a gluten protein typically treated (partially or fully) with transglutaminase. Such equivalent peptides can be determined by aligning the sequences of other gluten proteins with the gluten protein from which the original epitope derives (for example using any of the programs mentioned herein). Transglutaminase is commercially available (e.g. Sigma T-5398).

The agent which is an analogue is capable of being recognised by a TCR which recognises (i). Therefore generally when the analogue is added to T cells in the presence of (i), typically also in the presence of an antigen presenting cell (APC) (such as any of the APCs mentioned herein), the analogue inhibits the recognition of (i), i.e. the analogue is able to compete with (i) in such a system.

The analogue may be one which is capable of binding the TCR which recognises (i). Such binding can be tested by standard techniques. Such TCRs can be isolated from T cells which have been shown to recognise (i) (e.g. using the method of the invention). Demonstration of the binding of the analogue to the TCRs can then shown by determining whether the TCRs inhibit the binding of the analogue to a substance that binds the analogue, e.g. an antibody to the analogue. Typically the analogue is bound to a class II MHC molecule (e.g. HLA-DQ2) in such an inhibition of binding assay.

Typically the analogue inhibits the binding of (i) to a TCR. In this case the amount of (i) which can bind the TCR in the presence of the analogue is decreased. This is because the analogue is able to bind the TCR and therefore competes with (i) for binding to the TCR.

T cells for use in the above binding experiments can be isolated from patients with coeliac disease, for example with the aid of the method of the invention. Other binding characteristics of the analogue may also be the same as (i), and thus typically the analogue binds to the same MHC class II molecule to which the peptide binds (HLA-DQ2 or -DQ8). The analogue typically binds to antibodies specific for (i), and thus inhibits binding of (i) to such antibodies.

The analogue is typically a peptide. It may have homology with (i), typically at least 70% homology, preferably at least 80, 90%, 95%, 97% or 99% homology with (i), for example over a region of at least 7, 8, 9, 10, 11, 12, 13, 14, 15 or more (such as the entire length of the analogue and/or (i), or across the region which contacts the TCR or binds the MHC molecule) contiguous amino acids. Methods of measuring protein homology are well known in the art and it will be understood by those of skill in the art that in the present context, homology is calculated on the basis of amino acid identity (sometimes referred to as "hard homology").

For example the UWGCG Package provides the BESTFIT program which can be used to calculate homology (for example used on its default settings) (Devereux et al (1984) *Nucleic Acids Research* 12, p 387-395). The PILEUP and BLAST algorithms can be used to calculate homology or align sequences (typically on their default settings), for example as described in Altschul S. F. (1993) J Mol Evol 36:290-300; Altschul, S, F et al (1990) J Mol Biol 215:403-10.

Software for performing BLAST analyses is publicly available through the National Center for Biotechnology Information on the world wide web through the Internet at, for example, "www.ncbi.nlm.nih.gov/". This algorithm involves first identifying high scoring sequence pair (HSPs) by identifying short words of length W in the query sequence that either match or satisfy some positive-valued threshold score T when aligned with a word of the same length in a database sequence. T is referred to as the neighbourhood word score threshold (Altschul et al, supra). These initial neighbourhood word hits act as seeds for initiating searches to find HSPs containing them. The word hits are extended in both directions along each sequence for as far as the cumulative alignment score can be increased. Extensions for the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLAST program uses as defaults a word length (W) of 11, the BLOSUM62 scoring matrix (see Henikoff and Henikoff (1992) Proc. Natl. Acad. Sci. USA 89: 10915-10919) alignments (B) of 50, expectation (E) of 10, M=5, N=4, and a comparison of both strands.

The BLAST algorithm performs a statistical analysis of the similarity between two sequences; see e.g., Karlin and Altschul (1993) Proc. Natl. Acad. Sci. USA 90: 5873-5787. One measure of similarity provided by the BLAST algorithm is the smallest sum probability (P(N)), which provides an indication of the probability by which a match between two nucleotide or amino acid sequences would occur by chance. For example, a sequence is considered similar to another sequence if the smallest sum probability in comparison of the first sequence to the second sequence is less than about 1, preferably less than about 0.1, more preferably less than about 0.01, and most preferably less than about 0.001.

The homologous peptide analogues typically differ from (i) by 1, 2, 3, 4, 5, 6, 7, 8 or more mutations (which may be substitutions, deletions or insertions). These mutations may be measured across any of the regions mentioned above in relation to calculating homology. The substitutions are preferably 'conservative'. These are defined according to the following Table Amino acids in the same block in the second column and preferably in the same line in the third column may be substituted for each other:

| ALIPHATIC | Non-polar | G A P |
| | | I L V |
| | Polar - uncharged | C S T M |
| | | N Q |
| | Polar - charged | D E |
| | | K R |
| AROMATIC | | H F W Y |

Typically the amino acids in the analogue at the equivalent positions to amino acids in (i) that contribute to binding the MHC molecule or are responsible for the recognition by the TCR, are the same or are conserved.

Typically the analogue peptide comprises one or more modifications, which may be natural post-translation modifications or artificial modifications. The modification may provide a chemical moiety (typically by substitution of a hydrogen, e.g. of a C—H bond), such as an amino, acetyl, hydroxy or halogen (e.g. fluorine) group or carbohydrate group. Typically the modification is present on the N or C terminus.

The analogue may comprise one or more non-natural amino acids, for example amino acids with a side chain different from natural amino acids. Generally, the non-natural amino acid will have an N terminus and/or a C terminus. The non-natural amino acid may be an L- or a D-amino acid.

The analogue typically has a shape, size, flexibility or electronic configuration that is substantially similar to (i). It is typically a derivative of (i). In one embodiment the analogue is a fusion protein comprising the sequence of any of SEQ ID NOS: 1-1927 and non-gluten sequence. Preferably, the analogue according to this embodiment is a fusion protein comprising the sequence of any of SEQ ID NOs: 1578-1579, 1582-1583, 1587-1593, 1600-1620, 1623-1655, 1656-1671, 1672-1698, 1699-1763, 1764-1768, 1769-1786, 1787-1829, 1895-1903, 1906, and 1908-1927 and non-gluten sequence In one embodiment the analogue is or mimics (i) bound to a MHC class II molecule. 2, 3, 4 or more of such complexes may be associated or bound to each other, for example using a biotin/streptavidin based system, in which typically 2, 3 or 4 biotin labelled MHC molecules bind to a streptavidin moiety. This analogue typically inhibits the binding of the (i)/MHC Class II complex to a TCR or antibody which is specific for the complex.

The analogue is typically an antibody or a fragment of an antibody, such as a Fab or F(ab')$_2$ fragment. The analogue may be immobilised on a solid support, particularly an analogue that mimics peptide bound to a MHC molecule.

The analogue is typically designed by computational means and then synthesised using methods known in the art. Alternatively the analogue can be selected from a library of compounds. The library may be a combinatorial library or a display library, such as a phage display library. The library of compounds may be expressed in the display library in the form of being bound to a MHC class II molecule, such as HLA-DQ2 or -DQ8. Analogues are generally selected from the library based on their ability to mimic the binding characteristics (i). Thus they may be selected based on ability to bind a TCR or antibody which recognises (i).

Typically analogues will be recognised by T cells to at least the same extent as any of the agents (i), for example at least to the same extent as the equivalent epitope is recognised in any of the assays described herein, typically using T cells from coeliac disease patients. Analogues may be recognised to these extents in vivo and thus may be able to induce coeliac disease symptoms to at least the same extent as any of the agents mentioned herein (e.g. in a human patient or animal model).

Analogues may be identified in a method comprising determining whether a candidate substance is recognised by a T cell receptor that recognises an epitope of the invention, recognition of the substance indicating that the substance is an analogue. Such TCRs may be any of the TCRs mentioned herein, and may be present on T cells. Any suitable assay mentioned herein can be used to identify the analogue. In one embodiment this method is carried out in vivo. As mentioned above preferred analogues are recognised to at least the same extent as the equivalent epitope, and so the method may be used to identify analogues which are recognised to this extent.

In one embodiment the method comprises determining whether a candidate substance is able to inhibit the recognition of an epitope of the invention, inhibition of recognition indicating that the substance is an analogue.

The agent may be a product comprising at least 2, 5, 10 or 20 agents as defined by (i) or (ii). Typically the composition comprises epitopes of the invention (or equivalent analogues) from different gluten proteins, such as any of the species or variety of or types of gluten protein mentioned herein. Preferred compositions comprise at least one epitope of the invention, or equivalent analogue, from all of the glutens present in any of the species or variety mentioned herein, or from 2, 3, 4 or more of the species mentioned herein (such as from the panel of species consisting of wheat, rye, barley, oats and triticale). Thus, the agent may be monovalent or multivalent.

According to certain embodiments of the invention, the agent does not have or is not based on a sequence disclosed in WO 02/083722 and/or WO 01/25793 and/or WO03/104273 and/or recited in any of SEQ ID NOS: 1555-1577, 1580-1581, 1584-1586, 1594-1599, 1621-1622 and/or is not an agent derived from A-gliadin, the sequence of which is given in FIG. 10.

Within SEQ ID NOs: 1-1927, a preferred subset is SEQ ID NOs: 1-1763. Within SEQ ID NOs: 1764-1927, preferred subsets are: (a) oat sequences 1764-1768, (b) rye sequences 1769-1786, (c) barley sequences 1787-1829, (d) wheat sequences 1895-1903, (e) wheat DQ8 sequences 1908-1927, and (f) combitope sequence 1906. Other preferred subsets are: (a) 1764-1768, (b) 1769-1773, (c) 1774-1786, (d) 1787-1792, (e) 1793-1829, (f) 1830-1894, (g) 1895-1903, (h) 1830-1903, (i) 1904-1906, (j) 1908-1916, (k) 1917-1927, and (l) 1908-1913, 1915-1923 and 1925-1927.

Within SEQ ID NOs: 1578-1579, 1582-1583, 1587-1593, 1600-1620, 1623-1655, 1656-1671, 1672-1698, 1699-1763, & 1764-1927, particularly preferred wheat epitopes are SEQ ID NOs: 1656-1671, 1830-1903, and 1907-1927.

Within SEQ ID NOs: 1830-1894 (Table 1), some sequences have N-terminal and C-terminal glycines. The invention extends to these sequences omitting the C-terminal glycine and/or the N-terminal glycine. Preferably, both the C-terminal glycine and the N-terminal glycine are omitted.

Diagnosis

As mentioned above the method of diagnosis of the invention may be based on the detection of T cells that bind the agent or on the detection of antibodies that recognise the agent.

The T cells that recognise the agent in the method (which includes the use mentioned above) are generally T cells that have been pre-sensitised in vivo to one or more gluten proteins. As mentioned above such antigen-experienced T cells have been found to be present in the peripheral blood.

In the method the T cells can be contacted with the agent in vitro or in vivo, and determining whether the T cells recognise the agent can be performed in vitro or in vivo. Thus the invention provides the agent for use in a method of diagnosis practiced on the human body. Different agents are provided for simultaneous, separate or sequential use in such a method.

The in vitro method is typically carried out in aqueous solution into which the agent is added. The solution will also comprise the T cells (and in certain embodiments the APCs discussed below). The term 'contacting' as used herein includes adding the particular substance to the solution.

Determination of whether the T cells recognise the agent is generally accomplished by detecting a change in the state of the T cells in the presence of the agent or determining whether the T cells bind the agent. The change in state is generally caused by antigen specific functional activity of the T cell after the TCR binds the agent. The change of state may be measured inside (e.g. change in intracellular expression of proteins) or outside (e.g. detection of secreted substances) the T cells.

The change in state of the T cell may be the start of or increase in secretion of a substance from the T cell, such as a cytokine, especially IFN-γ, IL-2 or TNF-α. Determination of IFN-γ secretion is particularly preferred. The substance can typically be detected by allowing it to bind to a specific binding agent and then measuring the presence of the specific binding agent/substance complex. The specific binding agent is typically an antibody, such as polyclonal or monoclonal antibodies. Antibodies to cytokines are commercially available, or can be made using standard techniques.

Typically the specific binding agent is immobilised on a solid support. After the substance is allowed to bind the solid support can optionally be washed to remove material which is not specifically bound to the agent. The agent/substance complex may be detected by using a second binding agent that will bind the complex. Typically the second agent binds the substance at a site which is different from the site which binds the first agent. The second agent is preferably an antibody and is labelled directly or indirectly by a detectable label.

Thus the second agent may be detected by a third agent that is typically labelled directly or indirectly by a detectable label. For example the second agent may comprise a biotin moiety, allowing detection by a third agent which comprises a streptavidin moiety and typically alkaline phosphatase as a detectable label.

In one embodiment the detection system which is used is the ex-vivo ELISPOT assay described in WO 98/23960. In that assay IFN-γ secreted from the T cell is bound by a first IFN-γ specific antibody that is immobilised on a solid support. The bound IFN-γ is then detected using a second IFN-γ specific antibody which is labelled with a detectable label. Such a labelled antibody can be obtained from MABTECH (Stockholm, Sweden). Other detectable labels which can be used are discussed below.

The change in state of the T cell that can be measured may be the increase in the uptake of substances by the T cell, such as the uptake of thymidine. The change in state may be an increase in the size of the T cells, or proliferation of the T cells, or a change in cell surface markers on the T cell.

In one embodiment the change of state is detected by measuring the change in the intracellular expression of proteins, for example the increase in intracellular expression of any of the cytokines mentioned above. Such intracellular changes may be detected by contacting the inside of the T cell with a moiety that binds the expressed proteins in a specific manner and which allows sorting of the T cells by flow cytometry.

In one embodiment when binding the TCR the agent is bound to an MHC class II molecule (typically HLA-DQ2 or -DQ8), which is typically present on the surface of an antigen presenting cell (APC). However as mentioned herein other agents can bind a TCR without the need to also bind an MHC molecule.

Generally the T cells which are contacted in the method are taken from the individual in a blood sample, although other types of samples which contain T cells can be used. The sample may be added directly to the assay or may be processed first. Typically the processing may comprise diluting of the sample, for example with water or buffer. Typically the sample is diluted from 1.5 to 100 fold, for example 2 to 50 or 5 to 10 fold.

The processing may comprise separation of components of the sample. Typically mononuclear cells (MCs) are separated from the samples. The MCs will comprise the T cells and APCs. Thus in the method the APCs present in the separated MCs can present the peptide to the T cells. In another embodiment only T cells, such as only CD4 T cells, can be purified from the sample. PBMCs, MCs and T cells can be separated from the sample using techniques known in the art, such as those described in Lalvani et al (1997) *J. Exp. Med.* 186, p 859-865.

In one embodiment, the T cells used in the assay are in the form of unprocessed or diluted samples, or are freshly isolated T cells (such as in the form of freshly isolated MCs or PBMCs) which are used directly ex vivo, i.e. they are not cultured before being used in the method. Thus the T cells have not been restimulated in an antigen specific manner in vitro. However the T cells can be cultured before use, for example in the presence of one or more of the agents, and generally also exogenous growth promoting cytokines. During culturing the agent(s) are typically present on the surface of APCs, such as the APC used in the method. Pre-culturing of the T cells may lead to an increase in the sensitivity of the method. Thus the T cells can be converted into cell lines, such as short term cell lines (for example as described in Ota et al (1990) *Nature* 346, p 183-187).

The APC that is typically present in the method may be from the same individual as the T cell or from a different host. The APC may be a naturally occurring APC or an artificial APC. The APC is a cell that is capable of presenting the peptide to a T cell. It is typically a B cell, dendritic cell or macrophage. It is typically separated from the same sample as the T cell and is typically co-purified with the T cell. Thus the APC may be present in MCs or PBMCs. The APC is typically a freshly isolated ex vivo cell or a cultured cell. It may be in the form of a cell line, such as a short term or immortalised cell line. The APC may express empty MHC class II molecules on its surface.

In the method one or more (different) agents may be used. Typically the T cells derived from the sample can be placed into an assay with all the agents which it is intended to test or the T cells can be divided and placed into separate assays each of which contain one or more of the agents.

The invention also provides the agents such as two or more of any of the agents mentioned herein (e.g. the combinations of agents which are present in the composition agent discussed above) for simultaneous separate or sequential use (eg. for in vivo use).

In one embodiment agent per se is added directly to an assay comprising T cells and APCs. As discussed above the T cells and APCs in such an assay could be in the form of MCs. When agents that can be recognised by the T cell without the need for presentation by APCs are used then APCs are not required. Analogues which mimic the original (i) bound to a MHC molecule are an example of such an agent.

In one embodiment the agent is provided to the APC in the absence of the T cell. The APC is then provided to the T cell, typically after being allowed to present the agent on its surface. The peptide may have been taken up inside the APC and presented, or simply be taken up onto the surface without entering inside the APC.

The duration for which the agent is contacted with the T cells will vary depending on the method used for determining recognition of the peptide. Typically $10^5$ to $10^7$, preferably $5 \times 10^5$ to $10^6$ PBMCs are added to each assay. In the case where agent is added directly to the assay its concentration is from $10^1$ to $10^3$ µg/ml, preferably 0.5 to 50 µg/ml or 1 to 10 µg/ml.

Typically the length of time for which the T cells are incubated with the agent is from 4 to 24 hours, preferably 6 to 16 hours. When using ex vivo PBMCs it has been found that $0.3 \times 10^6$ PBMCs can be incubated in 10 µg/ml of peptide for 12 hours at 37° C.

The determination of the recognition of the agent by the T cells may be done by measuring the binding of the agent to the T cells (this can be carried out using any suitable binding assay format discussed herein). Typically T cells which bind the agent can be sorted based on this binding, for example using a FACS machine. The presence of T cells that recognise the agent will be deemed to occur if the frequency of cells sorted using the agent is above a "control" value. The frequency of antigen-experienced T cells is generally 1 in $10^6$ to 1 in $10^3$, and therefore whether or not the sorted cells are antigen-experienced T cells can be determined.

The determination of the recognition of the agent by the T cells may be measured in vivo. Typically the agent is administered to the host and then a response which indicates recognition of the agent may be measured. The agent is typically administered intradermally or epidermally. The agent is typically administered by contacting with the outside of the skin, and may be retained at the site with the aid of a plaster or dressing. Alternatively the agent may be administered by needle, such as by injection, but can also be administered by other methods such as ballistics (e.g. the ballistics techniques which have been used to deliver nucleic acids). EP-A-0693119 describes techniques that can typically be used to administer the agent. Typically from 0.001 to 1000 µg, for example from 0.01 to 100 µg or 0.1 to 10 µg of agent is administered.

In one embodiment a product can be administered which is capable of providing the agent in vivo. Thus a polynucleotide capable of expressing the agent can be administered, typically in any of the ways described above for the administration of the agent. The polynucleotide typically has any of the characteristics of the polynucleotide provided by the invention which is discussed below. The agent is expressed from the polynucleotide in vivo. Typically from 0.001 to 1000 µg, for example from 0.01 to 100 µg or 0.1 to 10 µg of polynucleotide is administered.

Recognition of the agent administered to the skin is typically indicated by the occurrence of inflammation (e.g. induration, erythema or oedema) at the site of administration. This is generally measured by visual examination of the site.

The method of diagnosis based on the detection of an antibody that binds the agent is typically carried out by contacting a sample from the individual (such as any of the samples mentioned here, optionally processed in any manner mentioned herein) with the agent and determining whether an antibody in the sample binds the agent, such a binding indicating that the individual has, or is susceptible to coeliac disease. Any suitable format of binding assay may be used, such as any such format mentioned herein.

Therapy

The identification of the immunodominant epitope and other epitopes described herein allows therapeutic products to be made which target the T cells which recognise this epitope (such T cells being ones which participate in the immune response against gluten proteins). These findings also allow the prevention or treatment of coeliac disease by suppressing (by tolerisation) an antibody or T cell response to the epitope(s).

Certain agents of the invention bind the TCR that recognises the epitope of the invention (as measured using any of the binding assays discussed above) and cause tolerisation of the T cell that carries the TCR. Such agents, optionally in association with a carrier, can therefore be used to prevent or treat coeliac disease.

Generally tolerisation can be caused by the same peptides which can (after being recognised by the TCR) cause antigen specific functional activity of the T cell (such as any such activity mentioned herein, e.g. secretion of cytokines). Such agents cause tolerisation when they are presented to the immune system in a 'tolerising' context.

Tolerisation leads to a decrease in the recognition of a T cell or antibody epitope by the immune system. In the case of a T cell epitope this can be caused by the deletion or anergising of T cells that recognise the epitope. Thus T cell activity (for example as measured in suitable assays mentioned herein) in response to the epitope is decreased. Tolerisation of an antibody response means that a decreased amount of specific antibody to the epitope is produced when the epitope is administered.

Methods of presenting antigens to the immune system in such a context are known and are described for example in Yoshida et al. Clin. Immunol Immunopathol. 82, 207-215 (1997), Thurau et al. Clin. Exp. Immunol. 109, 370-6 (1997), and Weiner et al. Res. Immunol. 148, 528-33 (1997). In particular certain routes of administration can cause tolerisation, such as oral, nasal or intraperitoneal. Tolerisation may also be accomplished via dendritic cells and tetramers presenting peptide. Particular products which cause tolerisation may be administered (e.g. in a composition that also comprises the agent) to the individual. Such products include cytokines, such as cytokines that favour a Th2 response (e.g. IL-4, TGF-$\beta$ or IL-10). Products or agent may be administered at a dose that causes tolerisation.

The invention provides a protein that comprises a sequence able to act as an antagonist of the T cell (which T cell recognises the agent). Such proteins and such antagonists can also be used to prevent or treat coeliac disease. The antagonist will cause a decrease in the T cell response. In one embodiment, the antagonist binds the TCR of the T cell (generally in the form of a complex with HLA-DQ2 or -DQ8) but instead of causing normal functional activation causing an abnormal signal to be passed through the TCR intracellular signalling cascade, which causes the T cell to have decreased function activity (e.g. in response to recognition of an epitope, typically as measured by any suitable assay mentioned herein).

In one embodiment the antagonist competes with epitope to bind a component of MHC processing and presentation pathway, such as an MHC molecule (typically HLA-DQ2 or -DQ8). Thus the antagonist may bind HLA-DQ2 or -DQ8 (and thus be a peptide presented by this MHC molecule) or a homologue thereof.

Methods of causing antagonism are known in the art. In one embodiment the antagonist is a homologue of the epitopes mentioned above and may have any of the sequence, binding or other properties of the agent (particularly analogues). The antagonists typically differ from any of the above epitopes (which are capable of causing a normal antigen specific function in the T cell) by 1, 2, 3, 4 or more mutations (each of which may be a substitution, insertion or deletion). Such antagonists are termed "altered peptide ligands" or "APL" in the art. The mutations are typically at the amino acid positions that contact the TCR.

For example, the antagonist may differ from the epitope by a substitution within the sequence that is equivalent to the sequence represented by amino acids 64 to 67 of A-gliadin (the sequence of A-gliadin is given in FIG. 10). Thus preferably the antagonist has a substitution at the equivalent of position 64, 65 or 67. Preferably the substitution is 64W, 67W, 67M or 65T.

Since the T cell immune response to the epitope of the invention in an individual is polyclonal, more than one antagonist may need to be administered to cause antagonism of T cells of the response which have different TCRs. Therefore the antagonists may be administered in a composition which comprises at least 2, 4, 6 or more different antagonists, which each antagonise different T cells.

The invention also provides a method of identifying an antagonist of a T cell (which recognises the agent), comprising contacting a candidate substance with the T cell and detecting whether the substance causes a decrease in the ability of the T cell to undergo an antigen specific response (e.g. using any suitable assay mentioned herein), the detecting of any such decrease in said ability indicating that the substance is an antagonist.

In one embodiment, the antagonists (including combinations of antagonists to a particular epitope) or tolerising (T cell and antibody tolerising) agents are present in a composition comprising at least 2, 4, 6 or more antagonists or agents which antagonise or tolerise to different epitopes of the invention, for example to the combinations of epitopes discussed above in relation to the agents which are a product comprising more than one substance.

Testing Whether a Composition is Capable of Causing Coeliac Disease

As mentioned above the invention provides a method of determining whether a composition is capable of causing coeliac disease comprising detecting the presence of a protein sequence which is capable of being modified by a transglutaminase to as sequence comprising the agent or epitope of the invention (such transglutaminase activity may be a human intestinal transglutaminase activity). Typically this is performed by using a binding assay in which a moiety which binds to the sequence in a specific manner is contacted with the composition and the formation of sequence/moiety complex is detected and used to ascertain the presence of the agent. Such a moiety may be any suitable substance (or type of substance) mentioned herein, and is typically a specific antibody. Any suitable format of binding assay can be used (such as those mentioned herein).

In one embodiment, the composition is contacted with at least 2, 5, 10 or more antibodies which are specific for epitopes of the invention from different gluten proteins, for example a panel of antibodies capable of recognising the combinations of epitopes discussed above in relation to agents of the invention which are a product comprising more than one substance.

The composition typically comprises material from a plant that expresses a gluten protein which is capable of causing coeliac disease (for example any of the gluten proteins or plants mentioned herein). Such material may be a plant part, such as a harvested product (e.g. seed). The material may be processed products of the plant material (e.g. any such product mentioned herein), such as a flour or food that comprises the gluten protein. The processing of food material and testing in suitable binding assays is routine, for example as mentioned in Kricka L J, J. Biolumin Chemilumin 13, 189-93 (1998).

Binding Assays

The determination of binding between any two substances mentioned herein may be done by measuring a characteristic of either or both substances that changes upon binding, such as a spectroscopic change.

The binding assay format may be a 'band shift' system. This involves determining whether the presence of one substance (such as a candidate substance) advances or retards the progress of the other substance during gel electrophoresis.

The format may be a competitive binding method which determines whether the one substance is able to inhibit the binding of the other substance to an agent which is known to bind the other substance, such as a specific antibody.

Mutant Gluten Proteins

The invention provides a gluten protein in which an epitope sequence of the invention, or sequence which can be modified by a transglutaminase to provide such a sequence has been mutated so that it no longer causes, or is recognised by, a T cell response that recognises the epitope. In this context the term recognition refers to the TCR binding the epitope in such a way that normal (not antagonistic) antigen-specific functional activity of the T cell occurs.

Methods of identifying equivalent epitopes in other gluten proteins are discussed above. The wild type of the mutated gluten protein is one which causes coeliac disease. Such a mutated gluten protein may have homology with the wild type of the mutated gluten protein, for example to the degree mentioned above (in relation to the analogue) across all of its sequence or across 15, 30, 60, 100 or 200 contiguous amino acids of its sequence. The sequences of other natural gluten proteins are known in the art.

The mutated gluten protein will not cause coeliac disease or will cause decreased symptoms of coeliac disease. Typically the mutation decreases the ability of the epitope to induce a T cell response. The mutated epitope may have a decreased binding to HLA-DQ2 or -DQ8, a decreased ability to be presented by an APC or a decreased ability to bind to or to be recognised (i.e. cause antigen-specific functional activity) by T cells that recognise the agent. The mutated gluten protein or epitope will therefore show no or reduced recognition in any of the assays mentioned herein in relation to the diagnostic aspects of the invention.

The mutation may be one or more deletions, additions or substitutions of length 1 to 3, 4 to 6, 6 to 10, 11 to 15 or more in the epitope, for example across any of SEQ ID NOS: 1-1927; or across equivalents thereof. Preferably the mutant gluten protein has at least one mutation in the sequence of any of SEQ ID NO: 1-1927. A preferred mutation is at the position equivalent to position 65 in A-gliadin (see FIG. 10). Preferably, a naturally occurring glutamine is substituted to histidine, tyrosine, tryptophan, lysine, proline, or arginine.

The invention thus also provides use of a mutation (such any of the mutations in any of the sequences discussed herein) in an epitope of a gluten protein, which epitope is an epitope of the invention, to decrease the ability of the gluten protein to cause coeliac disease.

In one embodiment the mutated sequence is able to act as an antagonist. Thus the invention provides a protein that comprises a sequence which is able to bind to a T cell receptor, which T cell receptor recognises an agent of the invention, and which sequence is able to cause antagonism of a T cell that carries such a T cell receptor.

The invention also provides proteins which are fragments of the above mutant gluten proteins, which are at least 7 amino acids long (e.g. at least 8, 9, 10, 11, 12, 13, 14, 15, 30, 60, 100, 150, 200, or 250 amino acids long) and which comprise the mutations discussed above which decrease the ability of the gluten protein to be recognised. Any of the mutant proteins (including fragments) mentioned herein may also be present in the form of fusion proteins, for example with other gluten proteins or with non-gluten proteins.

The equivalent wild type protein to the mutated gluten protein is typically from a graminaceous monocotyledon, such as a plant of a genus selected from *Triticum, Secale, Hordeum, Triticale* or *Avena*, (e.g. wheat, rye, barley, oats or triticale). For example, the protein may be an α, αβ, β, γ or ω gliadin or an avenin.

Kits

The invention also provides a kit for carrying out the method comprising one or more agents and optionally a means to detect the recognition of the agent by the T cell. Typically the different agents are provided for simultaneous, separate or sequential use. Typically the means to detect recognition allows or aids detection based on the techniques discussed above.

Thus the means may allow detection of a substance secreted by the T cells after recognition. The kit may thus additionally include a specific binding moiety for the substance, such as an antibody. The moiety is typically specific for IFN-γ. The moiety is typically immobilised on a solid support. This means that after binding the moiety the substance will remain in the vicinity of the T cell which secreted it. Thus "spots" of substance/moiety complex are formed on the support, each spot representing a T cell which is secreting the substance. Quantifying the spots, and typically comparing against a control, allows determination of recognition of the agent.

The kit may also comprise a means to detect the substance/moiety complex. A detectable change may occur in the moiety itself after binding the substance, such as a colour change. Alternatively a second moiety directly or indirectly labelled for detection may be allowed to bind the substance/moiety complex to allow the determination of the spots. As discussed above the second moiety may be specific for the substance, but binds a different site on the substance than the first moiety.

The immobilised support may be a plate with wells, such as a microtitre plate. Each assay can therefore be carried out in a separate well in the plate.

The kit may additionally comprise medium for the T cells, detection moieties or washing buffers to be used in the detection steps. The kit may additionally comprise reagents suitable for the separation from the sample, such as the separation of PBMCs or T cells from the sample. The kit may be designed to allow detection of the T cells directly in the sample without requiring any separation of the components of the sample.

The kit may comprise an instrument which allows administration of the agent, such as intradermal or epidermal administration. Typically such an instrument comprises plaster, dressing or one or more needles. The instrument may allow ballistic delivery of the agent. The agent in the kit may be in the form of a pharmaceutical composition.

The kit may also comprise controls, such as positive or negative controls. The positive control may allow the detection system to be tested. Thus the positive control typically mimics recognition of the agent in any of the above methods. Typically in the kits designed to determine recognition in vitro the positive control is a cytokine. In the kit designed to detect in vivo recognition of the agent the positive control may be antigen to which most individuals should response.

The kit may also comprise a means to take a sample containing T cells from the host, such as a blood sample. The kit may comprise a means to separate mononuclear cells or T cells from a sample from the host.

Polynucleotides, Cells, Transgenic Mammals and Antibodies

The invention also provides a polynucleotide which is capable of expression to provide the agent or mutant gluten proteins. Typically the polynucleotide is DNA or RNA, and is single or double stranded. The polynucleotide will preferably comprise at least 50 bases or base pairs, for example 50 to 100, 100 to 500, 500 to 1000 or 1000 to 2000 or more bases or base pairs. The polynucleotide therefore comprises a sequence which encodes the sequence of any of SEQ ID NO: 1-1927 or any of the other agents mentioned herein. To the 5' and 3' of this coding sequence the polynucleotide of the invention has sequence or codons which are different from the sequence or codons 5' and 3' to these sequences in the corresponding gluten protein gene.

5' and/or 3' to the sequence encoding the peptide the polynucleotide has coding or non-coding sequence. Sequence 5' and/or 3' to the coding sequence may comprise sequences which aid expression, such as transcription and/or translation, of the sequence encoding the agent. The polynucleotide may be capable of expressing the agent prokaryotic or eukaryotic cell. In one embodiment the polynucleotide is capable of expressing the agent in a mammalian cell, such as a human, primate or rodent (e.g. mouse or rat) cell.

A polynucleotide of the invention may hybridise selectively to a polynucleotide that encodes a gluten protein from which the agent is derived at a level significantly above background. Selective hybridisation is typically achieved using conditions of medium to high stringency (for example 0.03M sodium chloride and 0.03M sodium citrate at from about 50° C. to about 60° C.). However, such hybridisation may be carried out under any suitable conditions known in the art (see Sambrook et al (1989), Molecular Cloning: A Laboratory Manual). For example, if high stringency is required, suitable conditions include 0.2×SSC at 60° C. If lower stringency is required, suitable conditions include 2×SSC at 60° C.

Agents or proteins of the invention may be encoded by the polynucleotides described herein.

The polynucleotide may form or be incorporated into a replicable vector. Such a vector is able to replicate in a suitable cell. The vector may be an expression vector. In such a vector the polynucleotide of the invention is operably linked to a control sequence which is capable of providing for the expression of the polynucleotide. The vector may contain a selectable marker, such as the ampicillin resistance gene.

The polynucleotide or vector may be present in a cell. Such a cell may have been transformed by the polynucleotide or vector. The cell may express the agent. The cell will be chosen to be compatible with the said vector and may for example be a prokaryotic (bacterial), yeast, insect or mammalian cell. The polynucleotide or vector may be introduced into host cells using conventional techniques including calcium phosphate precipitation, DEAE-dextran transfection, or electroporation.

The invention provides processes for the production of the proteins of the invention by recombinant means. This may comprise (a) cultivating a transformed cell as defined above under conditions that allow the expression of the protein; and preferably (b) recovering the expressed polypeptide. Optionally, the polypeptide may be isolated and/or purified, by techniques known in the art.

The invention also provides TCRs which recognise (or bind) the agent, or fragments thereof which are capable of such recognition (or binding). These can be present in the any form mentioned herein (e.g. purity) discussed herein in relation to the protein of the invention. The invention also provides T cells which express such TCRs which can be present in any form (e.g. purity) discussed herein for the cells of the invention.

The invention also provides monoclonal or polyclonal antibodies which specifically recognise the agents (such as any of the epitopes of the invention) and which recognise the mutant gluten proteins (and typically which do not recognise the equivalent wild-type gluten proteins) of the invention, and methods of making such antibodies. Antibodies of the invention bind specifically to these substances of the invention.

For the purposes of this invention, the term "antibody" includes antibody fragments such as Fv, F(ab) and F(ab')$_2$ fragments, as well as single-chain antibodies.

A method for producing a polyclonal antibody comprises immunising a suitable host animal, for example an experimental animal, with the immunogen and isolating immunoglobulins from the serum. The animal may therefore be inoculated with the immunogen, blood subsequently removed from the animal and the IgG fraction purified. A method for producing a monoclonal antibody comprises immortalising cells which produce the desired antibody. Hybridoma cells may be produced by fusing spleen cells from an inoculated experimental animal with tumour cells (Kohler and Milstein (1975) *Nature* 256, 495-497).

An immortalized cell producing the desired antibody may be selected by a conventional procedure. The hybridomas may be grown in culture or injected intraperitoneally for formation of ascites fluid or into the blood stream of an allogenic host or immunocompromised host. Human antibody may be prepared by in vitro immunisation of human lymphocytes, followed by transformation of the lymphocytes with Epstein-Barr virus.

For the production of both monoclonal and polyclonal antibodies, the experimental animal is suitably a goat, rabbit, rat or mouse. If desired, the immunogen may be administered as a conjugate in which the immunogen is coupled, for example via a side chain of one of the amino acid residues, to a suitable carrier. The carrier molecule is typically a physiologically acceptable carrier. The antibody obtained may be isolated and, if desired, purified.

The polynucleotide, agent, protein or antibody of the invention, may carry a detectable label. Detectable labels which allow detection of the secreted substance by visual inspection, optionally with the aid of an optical magnifying means, are preferred. Such a system is typically based on an enzyme label which causes colour change in a substrate, for example alkaline phosphatase causing a colour change in a substrate. Such substrates are commercially available, e.g. from BioRad. Other suitable labels include other enzymes such as peroxidase, or protein labels, such as biotin; or radioisotopes, such as $^{32}$P or $^{35}$S. The above labels may be detected using known techniques.

Polynucleotides, agents, proteins, antibodies or cells of the invention may be in substantially purified form. They may be in substantially isolated form, in which case they will generally comprise at least 80% e.g. at least 90, 95, 97 or 99% of the polynucleotide, peptide, antibody, cells or dry mass in the preparation. The polynucleotide, agent, protein or antibody is typically substantially free of other cellular components. The polynucleotide, agent, protein or antibody may be used in such a substantially isolated, purified or free form in the method or be present in such forms in the kit.

The invention also provides a transgenic non-human mammal which expresses a TCR of the invention. This may be any of the mammals discussed herein (e.g. in relation to the production of the antibody). Preferably the mammal has, or is susceptible, to coeliac disease. The mammal may also express HLA-DQ2 or -DQ8 or HLA-DR3-DQ2 and/or may be given a diet comprising a gluten protein which causes coeliac disease (e.g. any of the gluten proteins mentioned herein). Thus the mammal may act as an animal model for coeliac disease.

The invention also provides a method of identifying a product which is therapeutic for coeliac disease comprising administering a candidate substance to a mammal of the invention which has, or which is susceptible to, coeliac disease and determining whether substance prevents or treats coeliac disease in the mammal, the prevention or treatment of coeliac disease indicating that the substance is a therapeutic product. Such a product may be used to treat or prevent coeliac disease.

The invention provides therapeutic (including prophylactic) agents or diagnostic substances (the agents, proteins and polynucleotides of the invention). These substances are formulated for clinical administration by mixing them with a pharmaceutically acceptable carrier or diluent. For example they can be formulated for topical, parenteral, intravenous, intramuscular, subcutaneous, intraocular, intradermal, epidermal or transdermal administration. The substances may be mixed with any vehicle which is pharmaceutically acceptable and appropriate for the desired route of administration. The pharmaceutically carrier or diluent for injection may be, for example, a sterile or isotonic solution such as Water for Injection or physiological saline, or a carrier particle for ballistic delivery.

The dose of the substances may be adjusted according to various parameters, especially according to the agent used; the age, weight and condition of the patient to be treated; the mode of administration used; the severity of the condition to be treated; and the required clinical regimen. As a guide, the amount of substance administered by injection is suitably from 0.01 mg/kg to 30 mg/kg, preferably from 0.1 mg/kg to 10 mg/kg.

The routes of administration and dosages described are intended only as a guide since a skilled practitioner will be able to determine readily the optimum route of administration and dosage for any particular patient and condition.

The substances of the invention may thus be used in a method of treatment of the human or animal body, or in a diagnostic method practised on the human body. In particular they may be used in a method of treating or preventing coeliac disease. The invention also provide the agents for use in a method of manufacture of a medicament for treating or preventing coeliac disease. Thus the invention provides a method of preventing or treating coeliac disease comprising administering to a human in need thereof a substance of the invention (typically a non-toxic effective amount thereof).

The agent of the invention can be made using standard synthetic chemistry techniques, such as by use of an automated synthesizer. The agent may be made from a longer polypeptide e.g. a fusion protein, which polypeptide typically comprises the sequence of the peptide. The peptide may be derived from the polypeptide by for example hydrolysing the polypeptide, such as using a protease; or by physically breaking the polypeptide. The polynucleotide of the invention can be made using standard techniques, such as by using a synthesiser.

Plant Cells and Plants that Express Mutant Gluten Proteins or Express Proteins Comprising Sequences which can Act as Antagonists The cell of the invention may be a plant cell, such as a cell of a graminaceous monocotyledonous species. The species may be one whose wild-type form expresses gluten proteins, such as any of the gluten proteins mentioned herein. Such a gluten protein may cause coeliac disease in humans. The cell may be of wheat, maize, oats, rye, rice, barley, triticale, sorghum, or sugar cane. Typically the cell is of the *Triticum* genus, such as *aestivum, spelta, polonicum* or *monococcum*.

The plant cell of the invention is typically one which does not express one or more wild-type gluten proteins (such as any of the gluten proteins mentioned herein which may cause coeliac disease), or one which does not express one or more gluten proteins comprising a sequence that can be recognised by a T cell that recognises the agent. Thus if the wild-type plant cell did express such a gluten protein then it may be engineered to prevent or reduce the expression of such a gluten protein or to change the amino acid sequence of the gluten protein so that it no longer causes coeliac disease (typically by no longer expressing the epitope of the invention).

This can be done for example by introducing mutations into 1, 2, 3 or more or all of such gluten protein genes in the cell, for example into coding or non-coding (e.g. promoter regions). Such mutations can be any of the type or length of mutations discussed herein (e.g., in relation to homologous proteins). The mutations can be introduced in a directed manner (e.g., using site directed mutagenesis or homologous recombination techniques) or in a random manner (e.g. using a mutagen, and then typically selecting for mutagenised cells which no longer express the gluten protein (or a gluten protein sequence which causes coeliac disease)).

In the case of plants or plant cells that express a protein that comprises a sequence able to act as an antagonist such a plant or plant cell may express a wild-type gluten protein (e.g. one which causes coeliac disease). Preferably though the presence of the antagonist sequence will cause reduced coeliac disease symptoms (such as no symptoms) in an individual who ingests a food comprising protein from the plant or plant cell.

The polynucleotide which is present in (or which was transformed into) the plant cell will generally comprise promoter capable of expressing the mutant gluten protein the plant cell. Depending on the pattern of expression desired, the promoter may be constitutive, tissue- or stage-specific; and/or inducible. For example, strong constitutive expression in plants can be obtained with the CAMV 35S, Rubisco ssu, or histone promoters. Also, tissue-specific or stage-specific promoters may be used to target expression of protein of the invention to particular tissues in a transgenic plant or to particular stages in its development. Thus, for example seed-specific, root-specific, leaf-specific, flower-specific etc promoters may be used. Seed-specific promoters include those described by Dalta et al (Biotechnology Ann. Rev. (1997), 3, pp. 269-296). Particular examples of seed-specific promoters are napin promoters (EP-A-0 255, 378), phaseolin promoters, glutenine promoters, helianthenine promoters (WO92/17580), albumin promoters (WO98/45460), oleosin promoters (WO98/45461) and ATS1 and ATS3 promoters (WO99/20775).

The cell may be in any form. For example, it may be an isolated cell, e.g. a protoplast, or it may be part of a plant tissue, e.g. a callus, or a tissue excised from a plant, or it may be part of a whole plant. The cell may be of any type (e.g. of any type of plant part). For example, an undifferentiated cell, such as a callus cell; or a differentiated cell, such as a cell of a type found in embryos, pollen, roots, shoots or leaves. Plant parts include roots; shoots; leaves; and parts involved in reproduction, such as pollen, ova, stamens, anthers, petals, sepals and other flower parts.

The invention provides a method of obtaining a transgenic plant cell comprising transforming a plant cell with a polynucleotide or vector of the invention to give a transgenic plant cell. Any suitable transformation method may be used (in the case of wheat the techniques disclosed in Vasil V et al, Biotechnology 10, 667-674 (1992) may be used). Preferred transformation techniques include electroporation of plant protoplasts and particle bombardment. Transformation may thus give rise to a chimeric tissue or plant in which some cells are transgenic and some are not.

The cell of the invention or thus obtained cell may be regenerated into a transgenic plant by techniques known in the art. These may involve the use of plant growth substances such as auxins, giberellins and/or cytokinins to stimulate the growth and/or division of the transgenic cell. Similarly, techniques such as somatic embryogenesis and meristem culture may be used. Regeneration techniques are well known in the art and examples can be found in, e.g. U.S. Pat. No. 4,459,355, U.S. Pat. No. 4,536,475, U.S. Pat. No. 5,464,763, U.S. Pat. No. 5,177,010, U.S. Pat. No. 5,187,073, EP 267,159, EP 604, 662, EP 672, 752, U.S. Pat. No. 4,945,050, U.S. Pat. No. 5,036,006, U.S. Pat. No. 5,100,792, U.S. Pat. No. 5,371,014, U.S. Pat. No. 5,478,744, U.S. Pat. No. 5,179,022, U.S. Pat. No. 5,565,346, U.S. Pat. No. 5,484,956, U.S. Pat. No. 5,508,468, U.S. Pat. No. 5,538,877, U.S. Pat. No. 5,554,798, U.S. Pat. No. 5,489,520, U.S. Pat. No. 5,510,318, U.S. Pat. No. 5,204,253, U.S. Pat. No. 5,405,765, EP 442,174, EP 486,233, EP 486,234, EP 539,563, EP 674,725, WO91/02071 and WO 95/06128.

In many such techniques, one step is the formation of a callus, i.e. a plant tissue comprising expanding and/or dividing cells. Such calli are a further aspect of the invention as are other types of plant cell cultures and plant parts. Thus, for example, the invention provides transgenic plant tissues and parts, including embryos, meristems, seeds, shoots, roots, stems, leaves and flower parts. These may be chimeric in the sense that some of their cells are cells of the invention and some are not. Transgenic plant parts and tissues, plants and seeds of the invention may be of any of the plant species mentioned herein.

Regeneration procedures will typically involve the selection of transformed cells by means of marker genes.

The regeneration step gives rise to a first generation transgenic plant. The invention also provides methods of obtaining transgenic plants of further generations from this first generation plant. These are known as progeny transgenic plants. Progeny plants of second, third, fourth, fifth, sixth and further generations may be obtained from the first generation transgenic plant by any means known in the art.

Thus, the invention provides a method of obtaining a transgenic progeny plant comprising obtaining a second-generation transgenic progeny plant from a first-generation transgenic plant of the invention, and optionally obtaining transgenic plants of one or more further generations from the second-generation progeny plant thus obtained.

Progeny plants may be produced from their predecessors of earlier generations by any known technique. In particular, progeny plants may be produced by: (a) obtaining a transgenic seed from a transgenic plant of the invention belonging to a previous generation, then obtaining a transgenic progeny plant of the invention belonging to a new generation by growing up the transgenic seed; and/or (b) propagating clonally a transgenic plant of the invention belonging to a previous generation to give a transgenic progeny plant of the invention belonging to a new generation; and/or (c) crossing a first-generation transgenic plant of the invention belonging to a previous generation with another compatible plant to give a transgenic progeny plant of the invention belonging to a new generation; and optionally (d) obtaining transgenic progeny plants of one or more further generations from the progeny plant thus obtained.

These techniques may be used in any combination. For example, clonal propagation and sexual propagation may be used at different points in a process that gives rise to a transgenic plant suitable for cultivation. In particular, repetitive back-crossing with a plant taxon with agronomically desirable characteristics may be undertaken. Further steps of removing cells from a plant and regenerating new plants therefrom may also be carried out.

Also, further desirable characteristics may be introduced by transforming the cells, plant tissues, plants or seeds, at any suitable stage in the above process, to introduce desirable coding sequences other than the polynucleotides of the invention. This may be carried out by the techniques described herein for the introduction of polynucleotides of the invention.

For example, further transgenes may be selected from those coding for other herbicide resistance traits, e.g. tolerance to: Glyphosate (e.g. using an EPSP synthase gene (e.g. EP-A-0,293,358) or a glyphosate oxidoreductase (WO 92/00377) gene); or tolerance to fosametin; a dihalobenzonitrile; glufosinate, e.g. using a phosphinothrycin acetyl transferase (PAT) or glutamine synthase gene (cf. EP-A-0, 242,236); asulam, e.g. using a dihydropteroate synthase gene (EP-A-0,369,367); or a sulphonylurea, e.g. using an ALS gene); diphenyl ethers such as acifluorfen or oxyfluorfen, e.g. using a protoporphyrogen oxidase gene); an oxadiazole such as oxadiazon; a cyclic imide such as chlorophthalim; a phenyl pyrazole such as TNP, or a phenopylate or carbamate analogue thereof.

Similarly, genes for beneficial properties other than herbicide tolerance may be introduced. For example, genes for insect resistance may be introduced, notably genes encoding *Bacillus thuringiensis* (Bt) toxins. Likewise, genes for disease resistance may be introduced, e.g. as in WO91/02701 or WO95/06128.

Typically, a protein of the invention is expressed in a plant of the invention. Depending on the promoter used, this expression may be constitutive or inducible. Similarly, it may be tissue- or stage-specific, i.e. directed towards a particular plant tissue (such as any of the tissues mentioned herein) or stage in plant development.

The invention also provides methods of obtaining crop products by harvesting, and optionally processing further, transgenic plants of the invention. By crop product is meant any useful product obtainable from a crop plant.

Products that Contain Mutant Gluten Proteins or Proteins that Comprise Sequence Capable of Acting as an Antagonist The invention provides a product that comprises the mutant gluten proteins or protein that comprises sequence capable of acting as an antagonist. This is typically derived from or comprise plant parts from plants mentioned herein which express such proteins. Such a product may be obtainable directly by harvesting or indirectly, by harvesting and further processing the plant of the invention. Directly obtainable products include grains. Alternatively, such a product may be obtainable indirectly, by harvesting and further processing. Examples of products obtainable by further processing are flour or distilled alcoholic beverages;

food products made from directly obtained or further processed material, e.g. baked products (e.g. bread) made from flour. Typically such food products, which are ingestible and digestible (i.e. non-toxic and of nutrient value) by human individuals.

In the case of food products that comprise the protein which comprises an antagonist sequence the food product may also comprise the wild-type gluten protein, but preferably the antagonist is able to cause a reduction (e.g. completely) in the coeliac disease symptoms after such food is ingested.

Deamidation

Where a sequence described herein includes a Gln residue, the invention also provides that sequence where the Gln residue has been deamidated to a Glu residue. One or more (e.g., 1, 2, 3, 4, 5, etc.) Gln residue(s) per sequence may be deamidated, but when there is more than one Gln residue, not all of them must be deamidated. Preferably, the Gln residues that are deamidated are those susceptible to deamidation by transglutaminase.

Examples where Gln may be deamidated are given in the sequence listing. For example, residue 4 of SEQ ID NO:1 can be a Gln residue or a Glu residue, residue 6 of SEQ ID NO:2 can be a Gln residue or a Glu residue, residues 4 and 7 of SEQ ID NO:6 can each independently be Gln or Glu residues, etc. The Gln residues that are susceptible to deamidation, and their deamidated Glu counterparts, are referred to as "Glx" residues.

Where the agent includes more than one Glx residue, these may be arranged in any configuration. For example, the Glx residues may be consecutive residues, and/or may be separated by one or more (e.g., 1, 2, 3, 4, 5, 6, 7, 8, etc.) other residues. As mentioned above, for HLA-DQ8 epitopes, the agent preferably comprises a Glx residue that is separated by seven residues from another Glx residue.

Preferred agents of the invention are deamidated agents, i.e., the agent comprises the one or more Glx residues in the Glu form. This can be achieved in various ways, e.g., by including Glu residues during production, or by converting Gln residues to Glu by deamidation. Conversion of Gln to Glu can be achieved by treating an agent that contains Gln residues that are susceptible to deamidation with a deamidating agent. The one or more Gln residues are preferably deamidated to Glu by transglutaminase, for example as described in the examples.

The skilled person will be able to determine which particular Gln residues in the agent are susceptible to deamidation and thus which residues should be Glu residues arising from deamidation of a Gln residue. For example, Gln-containing sequences susceptible to deamidation by transglutaminase generally conform to a motif: e.g., QXPX (SEQ ID NO: 1929), QXPF(Y) (SEQ ID NO: 1943), QXX (FYMILVW) (SEQ ID NO: 1942), QXPF (SEQ ID NO: 1944), QXX(FY) (SEQ ID NO: 1945), PQ(QL)P(FY)P (SEQ ID NO: 1946). For example, the sequence PQ(QL)P (FY)P (SEQ ID NO: 1946) facilitates deamidation of the underlined Q at position 2 by transglutaminase.

In particular, agents comprising the deamidated versions of SEQ ID NOs: 1-1927 are preferred (where such sequences are not already deamidated). Most preferably, the agents of the invention comprise the transglutaminase-deamidated versions of SEQ ID NOs: 1-1927 (again, where not already deamidated). Analogues and equivalents of these agents, as defined herein, are also encompassed within the scope of the invention.

EXAMPLES

The Invention is Illustrated by the Following Nonlimiting Examples:

Initial Gliadin Epitope Screening Library

In initial experiments involving 29 HLA-DQ2+ individuals with coeliac disease on long-term gluten free diet, interferon-gamma ELISPOT assays were used to screen a previous Pepset (described in WO 03/104273, which is incorporated herein by reference) initially as pools of peptides and then in 15 subjects as individual peptides with and without deamidation by tTG. This Pepset library consisted of 652 20mer gliadin peptides spanning all unique 12mers contained within all Genbank entries described as wheat gliadins found in September 2001. This Pepset library was designed "manually" from gene-derived protein sequences aligned using ClustalW software (MegAlign) arranged into phylogenetic groupings.

Approximately 0.6 micromole of each of 652 of the 20mers was provided. Two marker 20mer peptides were included in each set of 96 (VLQQHNIAHGSSQV-LQESTY—peptide 161 (SEQ ID NO: 1931), and IKDF-HVYFRESRDALWKGPG (SEQ ID NO: 1932)) and were characterized by reverse phase-HPLC and amino acid sequence analysis. Average purities of these marker peptides were 19% and 50%, respectively. Peptides were initially dissolved in acetonitrile (10%) and Hepes 100 mM to 10 mg/ml. The final concentration of individual peptides incubated with PBMC for the IFNγ ELISpot assays was 20 mcg/ml. These peptides were deamidated by incubation with guinea pig tissue tTG (Sigma T5398) in the ratio 100:32 mcg/ml for two hours at 37° C. Peptides solutions were stored at −20° C. and freshly thawed prior to use. These studies were conducted in Oxford, UK. ELISpot assays were performed as described for those conducted in Melbourne, Australia (all other studies described herein). "Oxford" data regarding subject responses to individual peptides was pooled with "Melbourne" data for subsequent "minimal" epitope analysis in the "EM algorithm" (see below).

Second Round Gliadin Epitope Screening Library

A second round gliadin epitope library was designed according the bioactive sequences identified from the initial gliadin epitope screening library of 652 20mers. Gliadin 20mers with mean bioactivity equivalent to >5% of the most potent gliadin 20mer (91: PQPFPPQLPYPQPQLPYPQP (SEQ ID NO: 1933)) in 15 HLA-DQ2+ subjects assessed with all 652 deamidated 20mers were defined. Since earlier studies (see WO 03/104273) indicated that deamidated pools of this Pepset were more potent than without deamidation, glutamine residues within bioactive 20mers potentially deamidated by tTG were identified according to the motif QXPX (SEQ ID NO: 1929), QXZ(FYWILVM) (SEQ ID NO: 1947) where x is any amino acid except proline, and P is proline, z is any amino acid, and FYWILVM represent hydrophobic amino acids (consistent with the motifs for tTG-mediated deamidation published by Vader W. et al J Exp Med 2002 *J. Exp. Med.* 195:643-649, PCT WO 03/066079, and Fleckenstein B. 2002. J Biol Chem 277: 34109-16).

12mer peptides were then identified in which each potential deamidation site could be in position 4, 6 or 7 in the 9mer located within HLA-DQ2 binding groove (HLA-DQ2 anchors at these positions show a preference for glutamate). Candidate 12mer core epitope sequences were then flanked with glycine followed by the N-terminal residue present in the parent gliadin polypeptide and at the C-terminal by the C-terminal residue present in the parent gliadin polypeptide followed by glycine (i.e. GXXXXXXXQXXXXXXG (SEQ ID NO: 1936)).

Peptides were synthesised with glutamine or glutamate in position 9. Peptides (100 mcg/ml) (+/− deamidation by tTG) were then assessed in interferon gamma ELISPOT assays using PBMC from 15 HLA-DQ2+ coeliac volunteers after gluten challenge. Results of these assays were analysed according to the EM algorithm (see below). In addition, the most potent distinct peptides were synthesised and purified to >80% (Mimotopes) and assessed in interferon gamma ELISPOT assays using PBMC from 15 HLA-DQ2+ coeliac volunteers after wheat gluten challenge.

Complete Gluten Epitope Screening Library

To make practical the design of a substantially larger peptide library spanning all wheat gliadin and glutenin, rye, barley, and oat gluten-like proteins (prolamines), and to confirm data from the previous gliadin peptide library, an iterative algorithm was developed to automate design of a minimal set of 20mers including all unique 12mers (excluding signal peptide sequences) in gluten proteins. The ScanSet algorithm is shown in FIG. 1.

The method tests for all possible peptide epitopes from a group of proteins whether they are potential antigens in a range of patients. T-cell epitopes range in size between 9 and 15 AA. To test all possible 12mers in a set of proteins, becomes quickly unfeasible because of the high numbers.

Here we use the fact that, for example, a 20mer peptide can cover up to 9 different 12mers. We therefore developed a combinatorial approach to cover all possible 12mers represented in a family of proteins.

20 amino acid (20mer) long peptides are generated that are tested as antigens, and that cover all 12mer peptide sequences that exist in the group of proteins. We define the length of peptides to generate as L (e.g. 20) and the length of the epitopes we want to cover as S. We developed a computer program that generates all uniquely occurring Lmers from a set of proteins. Further, we generate all uniquely occurring Smers from this set of proteins. Next we select a set of N Lmers that contains all sequences of Lmers. FIG. 1 outlines how this algorithm works.

On 16 Jun. 2003, Genbank contained accession numbers for 53 alpha/beta, 53 gamma and 2 omega gliadins, and 77 LMW and 55 HMW glutenins from *T. aestivum*, 59 hordeins, 14 secalins, and 20 avenins (see FIG. 2A and FIG. 2B). In total, ScanSet identified 18117 unique 12mers contained in the 225 gluten gene products.

All unique gluten 12mers could be subsumed in 2922 20mers. These 20mers were synthesised in a Pepset peptide library (Mimotopes Inc., Melbourne, Australia). Pepset peptides were synthesized in batches of 96 (Mimotopes Inc., Melbourne Australia). Approximately 0.7 to 1.3 micromole of each of 2922 20mers was provided. Two marker 20mer peptides were included in each set of 96 (one representative peptide from the 94 other peptides on each particular plate, and IKDFHVYFRESRDALWKGPG (SEQ ID NO: 1932)) and were characterized by reverse phase-HPLC and mass spectroscopy. Average purities of these marker peptides were 36% (range: 5-68%) and 64% (range: 55-71%), respectively.

Peptides were initially dissolved in aqueous acetonitrile (50%). Peptides in aqueous acetonitrile were transferred to sterile 96-well plates and diluted in sterile PBS with 1 mM calcium (250 mcg/ml) and then incubated with tTG (25 mcg/ml) (Sigma T5398) for 6 h 37° C. and then stored frozen (−20° C.) until use.

Subjects all had biopsy-proven coeliac disease and had followed a strict gluten free diet for at least 6 months. All subjects possessed HLA-DQB01*02 (HLA-DQ2) alone (n=100) or HLA-DQA1*03 and HLA-DQB1*0302 (HLA-DQ8) alone (n=5). In all cases, tTG-IgA was assessed before gluten challenge and was in the normal range (30% of initial volunteers were found to have elevated tTG-IgA and were excluded since chronic gluten exposure is associated with failure to induce peripheral blood gluten-specific T-cells by short-term gluten challenge). Volunteers consumed Baker's Delight "white bread block loaf" (200 g daily for three days) or Uncle Toby's oats (100 g daily for three days). All but three subjects completed the three day challenge (one withdrew after first mouthful of bread, and the other two vomited after initial two slices of bread. Data from the latter two were included in subsequent analysis). Blood (300 ml) was drawn six days after commencing gluten challenge. Gluten peptide-specific IFNγ ELISpot responses have not been found in our previous studies, and so "pre-challenge" blood was not assessed in this set of experiments (Anderson, R P et al 2000. *Nat. Med.* 6:337-342, WO 01/25793, WO 03/104273).

Figure 4:
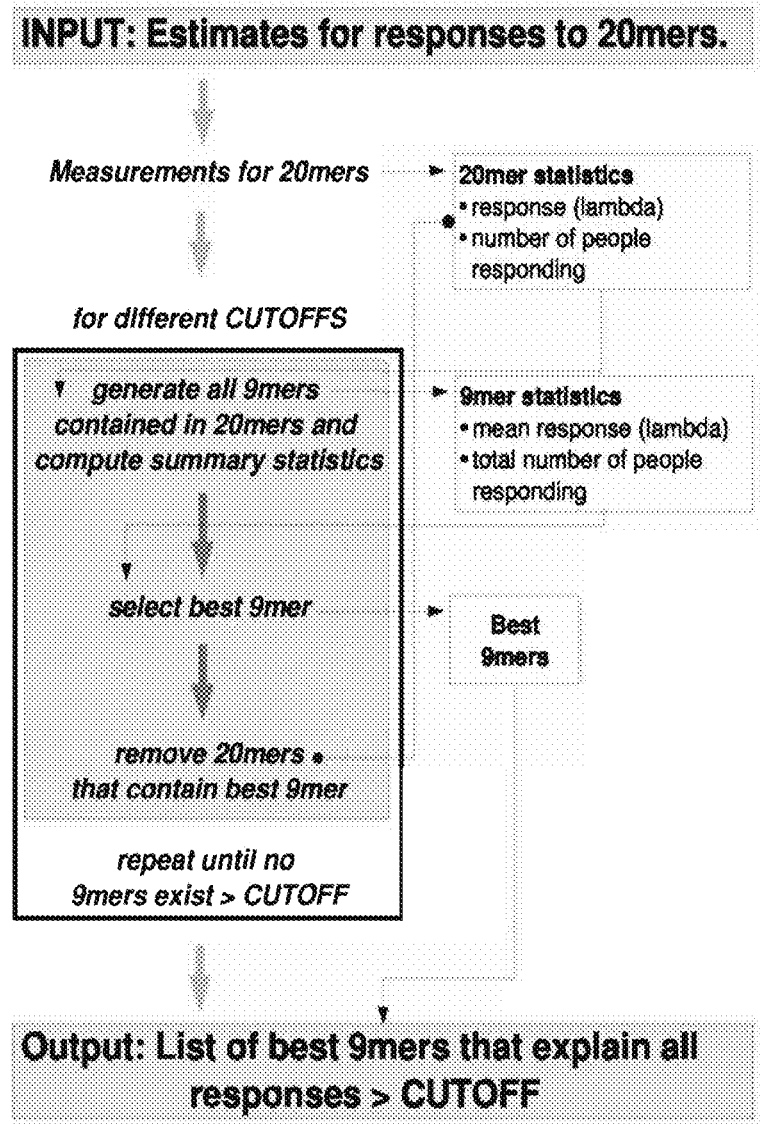
FIG. 4 shows an iterative procedure to find minimal set of responsive epitopes.

IFNγ ELISpot assays (Mabtech, Sweden) were performed in 96-well plates (MAIP S-45, Millipore) in which each well contained 25 mcl of peptide solution and 100 mcl of PBMC ($2-8\times10^5$/well) in RPMI containing 10% heat inactivated human AB serum. After development and drying, IFNγ ELISpot plates were assessed using the MAIP automated ELISpot plate counter. Data was then analysed according to a novel algorithm (Expectation Maximization: EM) to define and quantify interferon-gamma responses to 9mer sequences contained within the peptide library (see FIG. 3 and below). 9mer peptides were then rationalised according to an algorithm that assumes redundancy in T-cell recognition, the "IterativeCluster" algorithm (see FIG. 4 and below), by allowing groups of amino acids with similar chemical properties at any one position in the 9mer, or for glutamate to replace glutamine at any position (assuming deamidation may have occurred).

Since there were data sets from only two HLA-DQ8+ individuals who were not also HLA-DQ2+, and these were utilizing only the 721 wheat gliadin 20mers from the "Complete gluten epitope screening library", bioactive peptides were identified by taking the average rank of peptide-specific IFNγ ELISPOT responses in the two subjects. For prediction of likely HLA-DQ8-restricted gliadin epitopes, it was assumed that a glutamine residue susceptible to tTG-mediated deamidation occupied either position 1 or 9 in potential 9mer core regions of epitopes, consistent with the HLA-DQ8 binding motif and the findings of van de Wal et al (van de Wal, Y. et al 1998. *J Immunol*. 161(4):1585-1588).

Expectation Maximization (EM) Algorithm to Analyze Data from ELISpot:

FIG. 3 shows an algorithm to analyze data coming from an assay using the ELISpot. T-cell responses to different peptides are measured in 96 well plates using T-cell assays. Assays are performed on many patients using many different peptide antigens. The result of the T-cell assays can be summarized in a table where the rows represent peptides and the columns patients and the individual measurements (counts) are in the table (e.g., see FIG. 3B). The purpose of the EM algorithm is to differentiate between response and non response of a patient to a peptide and to estimate a mean rate of response and a proportion of people responding for each peptide.

Responses are measured for a number of different patients (i will be used to indicate the patient) and for many different peptides (j will be used to indicate the peptide). Each measurement (yij) represents a count of T-cells from patient i responding to peptide j. In order to estimate, whether a measurement for a certain peptide in a patient can be called a response or whether it is more likely to be coming from a background distribution, we propose a model for an incomplete data problem, with yij being the observed count of spots and zij an unobserved indicator, whether person i responds to peptide j.

The observed number of counts yij are modelled to come from independent Poisson distributions: poisson($\alpha i$, $\lambda j$), if patient i is responding to peptide j, i.e. zij=1, and poisson($\alpha i$, $\lambda 0$), if patient i is not responding to peptide j, i.e. zij=0.

Complete data: yij (observed counts), zij (response indicator, not observed).

Parameters: $\theta=(\alpha i, \lambda j, \lambda 0, pj)$
  $\alpha i$: Patients overall responsiveness.
  $\lambda j$: Peptide induced rate of response.
  $\lambda 0$: Background rate of response.
  pj: Proportion of people responding to peptide j.

EM Algorithm:
  Set variables initially to random values
  E-step: compute likelihood
  M-step: maximize likelihood function
  Iterate E- and M-step Iterative Procedure to Find Minimal Set of Responsive Epitopes A program to compute a minimal set of peptides for use in a vaccine based on the T-cell responses estimated in the EM algorithm was developed. We measured T-Cell responses to Lmers from a group of proteins. The peptides were generated to cover all possible Smers. We estimated the following parameters for the response by an EM algorithm: rate of response, number of people responding, proportion of people responding. The proportion of people responding multiplied with the estimated rate of response is used as a criterion to define epitopes which are good antigens. Many of the measured Lmers contain the same Smer epitopes. In order to find the epitopes (Smers) which can explain all the responses in Lmers we select the Smer which is contained in Lmers that in the mean have the highest responses. Then we remove all Lmers that contain this Smer from our measurements. Next we select the Smer with the highest responses in the remaining Lmers. We iterate this procedure until no Smers with responses higher than a specified cutoff exist. We use several iterations with different cutoffs. This process is sketched in FIG. 4. The such defined list of clustered Lmers can be used as a basis to define the optimal epitopes and select peptides that function as good antigens.

HLA-DQ2 Epitopes in Wheat Gluten

HLA-DQ2 epitopes in wheat gliadins and glutenins were identified using PBMC collected on day 6 after commencing gluten challenge in a total of 76 HLA-DQ2+ individuals in gamma-interferon ELISPOT assays (Initial gliadin epitope library: n=15, Second round gliadin epitope screening library: n=15, Complete gluten epitope screening library: n=46). All data relating to individual peptide responses in coeliac subjects was pooled and analysed by the EM algorithm.

A series of 9mer sequences were identified and ordered according to the intensity of gamma-interferon responses and the proportion of individuals responding (see FIG. 5A, FIG. 5B, FIG. 5C, FIG. 5D, FIG. 5E, FIG. 5F, FIG. 5G, FIG. 5H, FIG. 5I, FIG. 5J, FIG. 5K, FIG. 5L, FIG. 5M, FIG. 5N, FIG. 5O, FIG. 5P, FIG. 5Q, FIG. 5R, FIG. 5S, FIG. 5T, FIG. 5U, FIG. 5V, FIG. 5W, FIG. 5X, FIG. 5Y, FIG. 5Z, and FIG. 5AA). Many of the sequences identified could be grouped in "superfamilies" allowing for several different amino acids with similar chemical properties to be present at any one position in the putative epitope (see FIG. 6A, FIG. 6B, FIG. 6C, and FIG. 6D). For example, in "Sequence 1" of FIG. 6A (SEQ ID NO: 1555) P(QR)P(QE)LP(FY)PQ, glutamine (Q) or arginine (R) are both accepted at position 2 except that Q generates a substantially more bioactive epitope.

By reviewing the 110 most "active" 9mer sequences identified by the EM algorithm, the "list" of 9mer motifs could be condensed to 41 9mers, many of which overlapped (for example "Sequence 1" and "2" (SEQ ID NOS: 1555 and 1558 respectively) overlap by 7 residues and are both present in A-gliadin 57-73 QE65). In selected cases, high-grade peptides were synthesised and confirmed the bioactivity of peptides identified by the EM algorithm (see FIG. 7).

HLA-DQ2 Epitopes in Oats Avenins

Avenin peptides were assessed after challenge with oats (n=30 subjects) or after wheat bread (n=8) in HLA-DQ2+ coeliac subjects. ELISPOT responses were found for the peptides found in FIG. 8. One of the reactive avenin peptides was homologous to a sequence in wheat gluten (SEQ ID NO: 1590).

Oats (Avenin) High Quality Peptide Studies

High grade avenin peptides were assessed 3 days after completing oats challenge with pure wheat-free oats, 100 g/d for 3 days ("day 6" PBMC interferon gamma ELISPOT responses). These peptides were designed upon peptides previously defined using the screening grade ("first round") avenin peptide library and on potential deamidation sites. There were 25 peptides (as 16mers) with purity verified by HPLC as >80%, and sequences confirmed by mass spectroscopy.

Interferon gamma ELISPOT responses to the high grade avenin peptides following deamidation by tTG were compared in 18 subjects with DQ2+ coeliac disease.

The dominant (>70% maximal response) peptides after oats challenge included: EQQFGQNIFSGFSVQL (SEQ ID NO: 1764) (11/18 subjects), QLRCPAIHSVVQAIIL (SEQ ID NO: 1765) (4/18 subjects), and QYQPYPEQEQPILQQQ (SEQ ID NO: 1766) (3/18 subjects). 2/18 subjects did not have avenin specific responses (defined by SFU (spot forming units)>3×blank) and 6/18 subjects mean maximal SFU were less than 10. Two additional peptides elicited positive responses: QIPEQLRCPAIHSVVQ (SEQ ID NO: 1767) (3/18 subjects) and EQYQPEQQPFMQPL (SEQ ID NO: 1768) (>40% maximal peptide response in 5/18 subjects). The panel of 25 peptides included several peptides similar to peptide 1490 (SEQYQPYPEQQEPFVQ (SEQ ID NO: 1948)) reported in Arentz-Hansen, PLoS Medicine (October 2004, vol. 1, issue 1 (84-92), however, that peptide induced a strong positive response in only one subject, and far weaker response in 5 subjects.

Interferon gamma ELISPOT responses to high grade avenin peptides were absent prior to gluten challenge, and were blocked by pre-treatment of PBMC with anti-HLA DQ but not anti-HLA DR antibody.

Rye and Barley Screening Peptide Libraries

Secalin and hordein 20mer first round peptide libraries were assessed 3 days after completing rye (bread, 100 g/d for 3 days) or barley (boiled, 100 g/d for 3 days) challenge ("day 6" PBMC interferon gamma ELISPOT responses). Although iterative analysis using 2nd and 3rd round peptide libraries to define epitopes has not yet been performed, the 20mers pre-treated with tTG found to induce "potent" responses shared substantial structural similarity to the bioactive peptides identified after wheat challenge. However, the dominant peptide sequences after rye or barley challenge did not include peptides with the PQPQLPY sequence (SEQ ID NO: 1937) found to be dominant after wheat challenge. The dominant (>70% maximal response) 20mer after rye challenge was usually PQQLFPLPQQPFPQPQQPFP (SEQ ID NO: 1769) (8/14 subjects), or occasionally QPFPQPQQPTPIQPQQPFPQ (SEQ ID NO: 1770) (4/14), QQPQQLFPQTQQSSPQQPQQ (SEQ ID NO: 1771) (1/14), PQTQQPQQPFPQPQQPQQLF (SEQ ID NO: 1772) (1/14) and/or QEQREGVQILLPQSHQQLVG (SEQ ID NO: 1773) (1/14). Additional peptides noted for greater than 40% maximal response in at least 1 subject include:

```
                                   (SEQ ID NO: 1774)
FPQQPQQPFPQPQQQLPLQP  (3/14, 2 > 70%)

(SEQ ID NO: 1775)
PQQPFPQQPEQIIPQQPQQP  (5/14, 3 > 70%)

(SEQ ID NO: 1776)
QQLPLQPQQPFPQPQQPIPQ  (6/14, 2 > 70%)

(SEQ ID NO: 1777)
QQPQQPFPLQPQQPVPQQPQ  (3/14, 1 > 70%)

(SEQ ID NO: 1778)
SIPQPQQPFPQPQQPFPQSQ  (4/14, 1 > 70%)

(SEQ ID NO: 1779)
QTQQSIPQPQQPFPQPQQPF  (3/14, 1 > 70%)

(SEQ ID NO: 1780)
NMQVGPSGQVEWPQQQPLPQ  (2/14, 1 > 70%)

(SEQ ID NO: 1781)
VGPSGQVSWPQQQPLPQPQQ  (2/14, 2 > 70%)

(SEQ ID NO: 1782)
QQPFLLQPQQPFSQPQQPFL  (1/14, 1 > 70%)

(SEQ ID NO: 1783)
FPLQPQQPFPQQPEQIISQQ  (5/14, 1 > 70%)

(SEQ ID NO: 1784)
PQQPQRPFAQQPEQIISQQP  (3/14, 1 > 70%)

(SEQ ID NO: 1785)
SPQQPQLPFPQPQQPFVVVV  (4/14, 1 > 70%)

(SEQ ID NO: 1786)
QQPSIQLSLQQQLNPCKNVL  (1/14, 1 > 70%)
```

Typically, the dominant peptides after barley challenge included one of six peptide motifs, or were one of eight other individual 20mers "dominant" in only one of 17 subjects after barley challenge. The six motifs identified:

```
                                   (SEQ ID NO: 1787)
QQPIPQQPQPY (SEQ ID NO: 1788)
PFPQPQQPFPW (SEQ ID NO: 1789)
LQPQQPFPQ (SEQ ID NO: 1790)
PQPQOASPL (SEQ ID NO: 1791)
IIPQQPQQPF (SEQ ID NO: 1792)
YPEQPQQPF
```

The barley hordein peptides showing at least 40% maximal peptide response in at least one subject include the following, wherein an asterisk indicates the eight individual peptides showing maximal response in a single individual:

```
                                   (SEQ ID NO: 1793)
QQQPFPQQPIPQQPQPYPQQ  (8/17, 2 > 70%)

(SEQ ID NO: 1794)
QQPQPFSQQPIPQQPQPYPQ  (9/17, 8 > 70%)

(SEQ ID NO: 1795)
PQQPVPQQPQPYPQQPQPFP  (5/17, 1 > 70%)

(SEQ ID NO: 1796)
PQPFPQQPIPQQPQPYPQQP  (6/17, 2 > 70%)

(SEQ ID NO: 1797)
YPQQPQPFPQQPIPQQPQPY  (6/17. 2 > 70%)

(SEQ ID NO: 1798)
QPQPYPQQPQPYPQQPFPQ   (7/17, 2 > 70%)

(SEQ ID NO: 1799)
QPQQPQPFPQQPVPQQPQPY  (5/17, 2 > 70%)

(SEQ ID NO: 1800)
PQPYPQQPQPFPQQPPFCQQ  (1/17, 1 > 70%)*

(SEQ ID NO: 1801)
QPFPQPQQPFPWQPQQPFPQ  (10/17,2 > 70%)

(SEQ ID NO: 1802)
PFPQQPQQPFPQPQQPFRQQ  (6/17, 3 > 70%)

(SEQ ID NO: 1803)
WQPQQPFPQPQQPFPLQPQQ  (9/17, 5 > 70%)*

(SEQ ID NO: 1804)
PWQPQQPFPQPQEPIPQQPQ  (1/17. 1 > 70%)

(SEQ ID NO: 1805)
QQPFPQPQQPIPYQPQQPFN  (5/17, 1 > 70%)

(SEQ ID NO: 1806)
PQQPQQPFPQPQQPFSWQPQ  (6/17, 2 > 70%)*

(SEQ ID NO: 1807)
QPQQPFPQPQQPIPYQPQQP  (4/17, 1 > 70%)*

(SEQ ID NO: 1808)
QSQQQFPQPQQPFPQQPQQP  (1/17, 0 > 70%)

(SEQ ID NO: 1809)
PFPQPQQPFSWQPQQPFLQP  (1/17, 0 > 70%)

(SEQ ID NO: 1810)
FPQPQEPFPQQPQQPFPLQP  (1/17, 0 > 70%)

(SEQ ID NO: 1811)
PFPQPQQPFPWQPQQPFPQP  (6/17, 0 > 70%)

(SEQ ID NO: 1812)
FPQYQIPTPLQPQQPFPQQP  (2/17, 1 > 70%)

(SEQ ID NO: 1813)
FPLQPQQPFPQQPQQPFPQQ  (1/17, 0 > 70%)

(SEQ ID NO: 1814)
QQPFPLQPQQPFPQPQPFPQ  (1/17, 0 > 70%)

(SEQ ID NO: 1815)
SPLQPQQPFPQGSEQIIPQQ  (1/17, 0 > 70%)

(SEQ ID NO: 1816)
PQQASPLQPQPQQASPLQPQ  (1/17, 1 > 70%)

(SEQ ID NO: 1817)
PQQPPFWPQQPFPQQPPFGL  (1/17, 1 > 70%)*

(SEQ ID NO: 1818)
PVLSQQQPCTQDQTPLLQEQ  (1/17, 1 > 70%)
```

-continued

RQLPKYIIPQQPQQPFLLQP (1/17, 1 > 70%) (SEQ ID NO: 1819)

QGSEQIIPQQPQQPFPLQPH (7/17, 3 > 70%)* (SEQ ID NO: 1820)

PQGSEQIIPQQPFPLQPQPF (2/17, 1 > 70%) (SEQ ID NO: 1821)

QPFPTPQQFFPYLPQQTFPP (4/17, 1 > 70%) (SEQ ID NO: 1822)

PFPQPPQQKYPEQPQQPFPW (1/17, 1 > 70%) (SEQ ID NO: 1823)

QKYPEQPQQPFPWQQPTIQL (1/17, 1 > 70%) (SEQ ID NO: 1824)

FQQPQQSYPVQPQQPFPQPQ (3/17, 1 > 70%) (SEQ ID NO: 1825)

QIPYVHPSILQQLNPCKVFL (1/17, 1 > 70%) (SEQ ID NO: 1826)

LAAQLPAMCRLEGGGGLLAS (1/17, 1 > 70%) (SEQ ID NO: 1827)

PYLPEELSPQYQIPTPLQPQ (1/17, 1 > 70%)* (SEQ ID NO: 1828)

VSPHPGQQTTVSPHQGQQTT (1/17, 1 > 70%)* (SEQ ID NO: 1829)

Second and Third Round Wheat Glutenin and Gliadin Peptide Libraries

The second round wheat gliadin and glutenin library was designed upon the sequences of 20mer wheat gliadin and glutenin peptides that induced at least 5% of the response (interferon gamma ELISPOT) stimulated by the most active transglutaminase (tTG) pre-treated (enzymatically deamidated) 20mer peptide in any subject. All 2nd round 16mer peptides were assessed in at least 18 subjects. The 2nd round library generated from the "Oxford" gliadin 20mer library had been assessed in ten subjects—this data was merged with data generated from the 18 subjects used to assess the new 2nd round (expanded) gliadin/glutenin library. Hence, individual 16mer peptides pre-treated with transglutaminase were assessed in either 18 (novel gliadin/glutenin sequences based on "Melbourne" 20mer library) or 28 subjects (gliadin sequences based on "Oxford" 20mer library). All 16mers identified for the second round Oxford library also fulfilled the selection criteria for the Melbourne second round library.

The second round peptide library data was analysed according to the "dominance" of peptide responses in the interferon gamma ELISPOT in individual subjects i.e. the percent response of an individual's PBMC to a specific peptide normalized against that individual's maximal peptide-induced response. Sequences of peptides that stimulated at least 40% of the maximal peptide-specific response in at least one subject are shown in Table 1 below. The dataset supports the consistency and "dominance" of peptides conforming to the sequences identified using the first round 20mer peptide library using the Expectation Maximization (EM) algorithm described above.

TABLE 1

Peptides confirmed in Second Round Library as at least 40% as active as the peptide with maximal activity in any one subject: Ranked according to potency of peptide family

| Peptide | SEQ ID NO: | >70% | 40-70% | 10-40% | <10% |
|---|---|---|---|---|---|
| G-QLPYPQPQLPYPQP-G | 1830 | 18/28 | 4/28 | 3/28 | 3/28 |
| G-LQPFPQPQLPYPQP-G | 1831 | 14/28 | 8/28 | Nil | 6/28 |
| G-LQPFPQPQLPFPQP-G | 1832 | 4/28 | 8/28 | 5/28 | 10/28 |
| G-LQPFPQPQLPYLQP-G | 1833 | 1/28 | 1/28 | 12/28 | 14/28 |
| G-LQPFPQPQLPYSQP-G | 1834 | 2/28 | 3/28 | 12/28 | 11/28 |
| G-LQPFPQPQLSYSQP-G | 1835 | Nil | 1/28 | 2/28 | 25/28 |
| G-QQPFPQPQQPFPWQ-G | 1837 | 9/28 | 8/28 | 5/28 | 6/28 |
| G-QQPFPQPQQPIPVQ-G | 1838 | 8/28 | 5/28 | 7/28 | 8/28 |
| G-QQPFPQPQQPFSQQ-G | 1839 | 4/28 | 7/28 | 8/28 | 9/28 |
| G-QQPFPQPQQPFCQQ-G | 1840 | 2/28 | 2/28 | 13/28 | 11/28 |
| G-GLERPWQQQPLPPQ-G | 1841 | 2/18 | 1/18 | Nil | 15/18 |
| G-QTFPHQPQQAFPQP-G | 1842 | 1/28 | 2/28 | Nil | 25/28 |
| LQQQCSPVAMPQRLAR | 1843 | 1/28 | 1/28 | 11/28 | 15/28 |
| QGQQGYYPISPQQSGQ | 1844 | 1/18 | 1/18 | 1/18 | 15/18 |
| PGQGQSGYYPTSPQQS | 1845 | 1/18 | 1/18 | Nil | 16/18 |
| QGQPGYYPTSPQQIGQ | 1846 | 1/18 | 1/18 | 1/18 | 15/18 |

TABLE 1-continued

Peptides confirmed in Second Round Library as at least 40% as active as the peptide with maximal activity in any one subject: Ranked according to potency of peptide family

| Peptide | SEQ ID NO: | >70% | 40-70% | 10-40% | <10% |
|---|---|---|---|---|---|
| GQGQSGYYPTSPQQSG | 1847 | 1/18 | Nil | 2/18 | 15/18 |
| QQGYYPTSPQQSGQGQ | 1848 | Nil | 1/18 | Nil | 17/18 |
| QGQQGYYPTSPQQPPQ | 1849 | Nil | 1/18 | Nil | Nil |
| QQGYYPISPQQLGQGQ | 1850 | Nil | 1/18 | Nil | Nil |
| YVPPDCSTINVPYANI | 1851 | 1/18 | 1/18 | 1/18 | 15/18 |
| IIMQQEQQEQRQGVQI | 1852 | 1/28 | Nil | 8/28 | 19/28 |
| VAHAIIMHQQQQQQE | 1853 | Nil | 1/28 | 2/28 | 25/28 |
| G-QPIPQQPQQPFPLQ-G | 1854 | 1/28 | Nil | 5/28 | |
| G-FPQLQQPQQPFPQQ-G | 1855 | 1/28 | Nil | 1/28 | 26/28 |
| G-FPQTQQPQQPFPQQ-G | 1856 | Nil | 1/28 | 2/28 | 25/28 |
| G-QPLSQQPQQTFPQQ-G | 1857 | Nil | 1/28 | Nil | 27/28 |
| G-QQPQQQPQQPFPQQ-G | 1858 | Nil | 1/28 | 5/28 | 22/28 |
| G-FPQPQQPQQPFPQQ-G | 1859 | Nil | 1/28 | 3/28 | 25/28 |
| G-FPQPQQPQQSFPQQ-G | 1860 | Nil | 1/28 | 1/28 | 26/28 |
| G-QPQQTFPQQPQLPF-G | 1861 | 1/18 | Nil | 2/18 | 15/18 |
| G-MQVDPSGQVQWPQQ-G | 1862 | 1/18 | Nil | Nil | 17/18 |
| G-IQVDPSGQVQWPQQ-G | 1863 | 1/18 | Nil | Nil | 17/18 |
| G-MQADPSGQVQWPQQ-G | 1864 | 1/18 | Nil | Nil | 17/18 |
| G-MQVDPSSQVQWPQQ-G | 1865 | 1/18 | Nil | Nil | 17/18 |
| G-QQEQQILQQILQQQ-G | 1866 | 1/18 | Nil | Nil | 17/18 |
| VPLYRTTTSVPFGVGT | 1867 | Nil | Nil | Nil | 17/18 |
| LQTLPSMCNVYIPPYC | 1868 | Nil | Nil | Nil | 17/18 |
| LALQTLPAMCNVYIPP | 1869 | Nil | Nil | Nil | 17/18 |
| DAIRAIIYSIVLQEQQ | 1870 | Nil | Nil | Nil | 17/18 |
| G-QQQFSQPQQQFPQP-G | 1871 | Nil | 5/28 | 7/28 | 16/28 |
| G-FFPQPQQQFPQPQQ-G | 1872 | Nil | 1/28 | 10/28 | 17/28 |
| G-FPQQPQQQFPQPQQ-G | 1873 | Nil | 1/28 | Nil | 27/28 |
| G-QQPFPQPQQQFPQP-G | 1874 | Nil | 1/28 | 12/28 | 15/28 |
| G-QPQPFLPQLPYPQP-G | 1875 | Nil | 4/28 | 9/28 | 15/28 |
| G-QQPFPQPQQQLPQP-G | 1876 | Nil | 3/28 | 6/28 | 19/28 |
| G-LPFPQQPQQPLPQP-G | 1877 | Nil | 2/18 | 4/18 | 12/18 |
| G-QQAFPQPQQTFPHQ-G | 1878 | Nil | 3/28 | 8/28 | 17/28 |
| G-QQPFTQPQQPTPIQ-G | 1879 | Nil | 1/28 | 4/28 | 23/28 |
| G-QQIFPQPQQTFPHQ-G | 1880 | Nil | 1/28 | 10/28 | 17/28 |
| G-QQQFIQPQQPFPQQ-G | 1881 | Nil | 2/28 | 11/28 | 15/28 |
| G-QPFPLQPQQPFPQQ-G | 1882 | Nil | 2/28 | 7/28 | 19/28 |

TABLE 1-continued

Peptides confirmed in Second Round Library as at least 40% as active as the peptide with maximal activity in any one subject: Ranked according to potency of peptide family

| Peptide | SEQ ID NO: | >70% | 40-70% | 10-40% | <10% |
|---|---|---|---|---|---|
| G-QPFPWQPQQPFPQQ-G | 1883 | Nil | 2/28 | 8/28 | 18/28 |
| G-QPTPIQPQQPFPQQ-G | 1884 | Nil | 2/28 | 5/28 | 21/28 |
| G-QVSFQQPQQQYPSP-G | 1885 | Nil | 2/28 | 4/28 | 22/28 |
| G-FFQQPQQQYPSSQQ-G | 1886 | Nil | 1/28 | 1/28 | 26/28 |
| G-GKSQVLQQSTYQLL-G | 1887 | Nil | 2/18 | 1/18 | 15/18 |
| GQVVNNHGQTVFNDIG | 1888 | Nil | 1/18 | 4/18 | |
| G-QPQLPFPQQPQQQF-G | 1889 | Nil | 1/28 | 2/28 | 25/28 |
| G-QPFPQPQQAQLPFP-G | 1890 | Nil | 1/28 | 2/28 | 25/28 |
| G-HQQPGQRQQGYYPT-G | 1891 | Nil | 1/18 | 1/18 | 16/18 |
| G-HQQFPQQQIPVVQP-G | 1892 | Nil | 1/18 | 1/18 | 16/18 |
| LEAVTSIALRTLPTMC | 1893 | Nil | 1/18 | 1/18 | |
| G-QQPQFSQQQQIPVI-G | 1894 | Nil | 1/28 | Nil | 17/18 |

The third round peptide library consisted of 74 peptides based upon structurally distinct sequences in the second round library found to induce at least 10% of the maximal response to any peptide in any subject. These peptides corresponded to wild-type (non-deamidated) sequences virtually identical to those used in the second round library. The distinct feature of this library was that it consisted of peptides with purity verified by HPLC as >80%, and with sequences confirmed by mass spectroscopy.

Interferon gamma ELSIPOT responses to the 3rd round library peptides following deamidation by tTG were compared in 14 subjects. Once again, sequences including the PQPQLPY motif (SEQ ID NO: 1937) were "dominant" in 9/14 subjects. However PFPQPQQPFPW (SEQ ID NO: 1894) stimulated >70% of maximal response in 1/14 subjects, PFPQQPQQPFPQ (SEQ ID NO: 1895) in 1/14, PQP-FLPQLPYPQP (SEQ ID NO: 1896) in 1/14, QPFPQPQQPQQP (SEQ ID NO: 1897) in 4/14 (including 3 subjects in whom PQPQLPY peptides (SEQ ID NO: 1937) were not potent epitopes) SGQGVSQSQQQSQQQ (SEQ ID NO: 1898) in 2/14 (including one in which PQPQLPY peptides (SEQ ID NO: 1937) were not potent), QYE-VIRSLVLRTLPNM (SEQ ID NO: 1899) and GLARSQM-LQQSICHVG (SEQ ID NO: 1900) each in one (the same) subject in whom PQPQLPY peptides (SEQ ID NO: 1937) were not potent epitopes, RTTTSVPFGVGTGVGA (SEQ ID NO: 1901) in 1/14 subjects and AIHTVIHSIIMQQEQQ (SEQ ID NO: 1902) in 1/14 subjects.

Many of the sequences tested in third round were structurally related and individual subject's responses were present or absent according to the "relatedness" of certain sequences, suggesting redundancy of peptides recognized by gluten specific T cells induced by in vivo gluten challenge.

Interferon gamma ELISPOT responses to 3rd round peptides were absent before gluten challenge, and were blocked by pre-treatment of PBMC with anti-HLA DQ but not HLA DR antibody.

Combitopes

The issue of epitope redundancy and the potential utility in diagnostics and therapeutics of peptides designed to combine "unique" dominant epitopes was addressed by comparing interferon gamma ELISPOT responses after wheat (n=16 HLA DQ2 coeliac disease subjects), rye (n=17) or barley (n=13) challenge to the sequences: QLQP-FPQPELPYPQPQL (SEQ ID NO: 1903) ("P04724E"), QPEQPFPQPEQPFPWQP (SEQ ID NO: 1904) ("626fEE"), and QLQPFPQPELPYPQPFPQQPEQPFPQPEQPFPWQP (SEQ ID NO: 1905) ("Combitope"). After rye and barley challenge the sum of the median ELISPOT responses (spot forming units) to P04724E and 626fEE were almost identical (99%, and 102%, respectively) to the response to a similar (optimal) concentration of the Combitope. However, after wheat challenge (n=16 subjects), median P04724E response was 89% of that to Combitope, and median 626fEE responses was 70% of the response to Combitope. These findings would be consistent with substantial redundancy of these related epitope sequences, P04724E and 626fEE, after wheat challenge but not after rye or barley, and that combining dominant epitope sequences within longer peptides does not reduce their biological availability. Hence, combitopes derived from selected potent epitopes may be efficient delivery devices for T cell epitope-based therapeutics and diagnostics in coeliac disease.

Epitopes in Wheat Gluten Associated with HLA-DQ8+ Coeliac Disease

Epitopes in wheat gliadins were identified using PBMC after gluten challenge in two individuals, one HLA-DQ8 homozygous, and one HLA-DQ8 heterozygote. Induced T-cell responses in other HLA-DQ8 (not DQ2) coeliac individuals responded weakly to gluten challenge and their data did not allow detailed analysis.

Deamidated 20mers including the core sequence: QGS-FQPSQQ (SEQ ID NO: 1906), corresponding to the known HLA-DQ8-restricted alpha-gliadin epitope (in which Q1 and Q9 are deamidated by tTG for optimal activity), induced moderately strong peptide responses. However, a series of "core" peptides were associated with more potent responses in 20mers derived from gamma and omega gliadins (see FIG. 9). The most potent peptides possessed glutamine in a sequence that would suggest susceptibility to deamidation separated by seven residues from a second glutamine also susceptible to deamidation (as found in QGSFQPSQQ (SEQ ID NO: 1906)) suggesting that these deamidated sequences would become high affinity binders for HLA-DQ8 following deamidation by tTG. (The binding motif for HLA-DQ8 favours glutamate at positions 1 and 9.) A further group of 20mers possessed glutamine residues susceptible to deamidation but not separated by seven residues from a second glutamine susceptible to tTG-mediated deamidation.

HLA DQ8 Coeliac Disease Gliadin and Glutenin Epitopes

Five subjects with coeliac disease that possess HLA DQ2 and HLA DQ8 alleles underwent wheat gluten challenge. PBMC from two subjects initially challenged were used to screen the first round "Melbourne" wheat gliadin 20mer library. The 20mer sequences identified using PBMC from these two HLA DQ8 CD subjects were dissected further by screening, in five HLA DQ8+DQ2− CD subjects including the two original subjects, a second round library based on reactive 20mers in the 1$^{st}$ round library. The 2$^{nd}$ round library consisted of screening grade overlapping 16mers, and 13mers predicted to correspond to tTG-mediated deamidation products of epitopes with the potential for deamidation of glutamine at position 1 and/or position 9 (consistent with the HLA DQ8 peptide binding motif). In addition, the 1400 glutenin (HMW and LMW) tTG-pretreated 20mers in the "Melbourne" wheat gluten library were also screened in these five subjects.

The most potent and consistently dominant gliadin 16mers were the related sequences VYIPPYCTIAPFGIFG (SEQ ID NO: 1907) (3/5 subjects >70% response to maximal gliadin 16mer) and AMCNVYIPPYCAMAPF (SEQ ID NO: 1908) also dominant in 3/5 subjects (4/5 subjects produced dominant responses to one or both of these peptides). In addition, a series of peptides derived from previously identified bioactive 20mers whose responses in the ELISPOT were enhanced or permissive to specific glutamine residues being deamidated were identified: (QE)QPTPIQP(QE) (SEQ ID NO: 1909), (QE)QPFPLQP(QE) (SEQ ID NO: 1910), (QE)QPIPVQP(QE) (SEQ ID NO: 1911), (QE)QPQQPFP(QE) (SEQ ID NO: 1912), (QE)QP(QE)LPFP(QE) (SEQ ID NO: 1913), (QE)GSFQPSQ(QE) (SEQ ID NO: 1914) (previously published HLA DQ8 epitope, van der Wal 1998), (QE)LPFP(QE)QP(QE) (SEQ ID NO: 1915), and (QE)QPFP(QE)QP(QE) (SEQ ID NO: 1916).

Screening the glutenin 20mer library identified a further series of sequences that were dominant in at least one of the five subjects. Dominant 20mer peptides shared the motifs or had the sequences: PQQQQQQLVQQQ (SEQ ID NO: 1917), QGIFLQPH(LQ)I(AS)QLEV (SEQ ID NO: 1918), QPGQGQQG(HY)Y (SEQ ID NO: 1919), QSRYEAIRAII(FY)S (SEQ ID NO: 1920), RTTTSVPFD (SEQ ID NO: 1921), QPPFWRQQP (SEQ ID NO: 1922), Q(PS)(PS)(FI)(PS)QQQQ (SEQ ID NO: 1923), (QPLR)GYYPTSPQ (SEQ ID NO: 1924) (previously identified HLA DQ8 epitope, van der Wal 2001), QGSYYPGQASPQ (SEQ ID NO: 1925), GYYPTSSLQPEQGQQGYYPT (SEQ ID NO: 1926), and QGQQLAQGQQGQQPAQVQQG (SEQ ID NO: 1927). Glutenin peptides were assessed after pretreatment with transglutaminase. Hence, the requirement for deamidation for these epitopes is not known.

A comprehensive library of "uncharacterised" screening grade peptides including all unique 12mer sequences encoded by genes present in Genbank defined as (bread making) wheat (*Triticum aestivum*), rye, barley, or oats gluten, gliadin, glutenin, secalin, hordein, or avenin have been assessed using T cells from HLA DQ2+ (and in some cases HLA DQ8+) coeliac disease volunteers six days after commencing in vivo gluten challenge. A relatively consistent pattern of epitope hierarchy has been identified in HLA DQ2 coeliac disease that is similar to but not identical after consumption of other grains toxic in coeliac disease. Peptides with the sequence PQPQLPY (SEQ ID NO: 1937) are dominant after wheat challenge in at least two thirds of HLA DQ2+ coeliac disease, but other epitopes are occasionally dominant while PQLPY peptides (SEQ ID NO: 1938) are essentially inactive in fewer than one in six HLA DQ2+ subjects with coeliac disease. The contribution of rare dominant epitopes will be better assessed after screening large numbers (e.g. >30) subjects (in progress). Epitope hierarchy after rye and barley consumption is similar to that after wheat with the exception that deamidated peptides similar to the gliadin/hordein/secalin sequences PQPQQPFP (SEQ ID NO: 1939) or PFPQQPQQP (SEQ ID NO: 1940) are usually dominant rather than PQPQLPY (SEQ ID NO: 1937) (a sequence unique to wheat alpha-gliadins). Combitopes that comprise serial and partially overlapping gluten epitopes are as active or more active than single epitopes alone and offer a means of efficiently delivering multiple gluten epitopes for T cell recognition. Such combitopes are therefore useful in design and delivery of peptide therapies in coeliac disease that target multiple unique T cell epitopes.

REFERENCES

1. Molberg O, et al. Nature Med. 4, 713-717 (1998).
2. Quarsten H, et al. Eur. J. Immunol. 29, 2506-2514 (1999).
3. Greenberg C S et al. FASEB 5, 3071-3077 (1991).
4. Mantzaris G, Jewell D. Scand. J. Gastroenterol. 26, 392-398 (1991).
5. Mauri L, et al. Scand. J. Gastroenterol. 31, 247-253 (1996).
6. Bunce M, et al. Tissue Antigens 46, 355-367 (1995).
7. Olerup O, et al. Tissue antigens 41, 119-134 (1993).
8. Mullighan C G, et al. Tissue-Antigens. 50, 688-92 (1997).
9. Plebanski M et al. Eur. J. Immunol. 28, 4345-4355 (1998).
10. Anderson D O, Greene F C. The alpha-gliadin gene family. II. DNA and protein sequence variation, subfamily structure, and origins of pseudogenes. Theor Appl Genet (1997) 95:59-65.
11. Arentz-Hansen H, Korner R, Molberg O, Quarsten H, Van der Wal Y, Kooy Y M C, Lundin K E A, Koning F, Roepstorff P, Sollid L M, McAdam S N. The intestinal T cell response to alpha-gliadin in adult celiac disease is focused on a single deamidated glutamine targeted by tissue transglutaminase. J Exp Med. 2000; 191:603-12.
12. Vader L W, de Ru A, van der Wal, Kooy Y M C, Benckhuijsen W, Mearin M L, Drijfhout J W, van Veelen P, Koning F. Specificity of tissue transglutaminase explains cereal toxicity in celiac disease. J Exp Med 2002; 195:643-649.
13. van der Wal Y, Kooy Y, van Veelan P, Pena S, Mearin L, Papadopoulos G, Koning F. Selective deamidation by tissue transglutaminase strongly enhances gliadin-specific T cell reactivity. J Immunol. 1998; 161:1585-8.

14. van der Wal Y, Kooy Y, van Veelan P, Pena S, Mearin L, Molberg O, Lundin K E A, Sollid L, Mutis T, Benckhuijsen W E, Drijfhout J W, Koning F. Proc Natl Acad Sci USA 1998; 95:10050-10054.
15. Vader W, Kooy Y, Van Veelen P et al. The gluten response in children with celiac disease is directed toward multiple gliadin and glutenin peptides. Gastroenterology 2002, 122:1729-37
16. Arentz-Hansen H, McAdam S N, Molberg O, et al. Celiac lesion T cells recognize epitopes that cluster in regions of gliadin rich in proline residues. Gastroenterology 2002, 123:803-809.

Each of the PCT publications, U.S. patents, other patents, journal references, and any other publications cited or referred to herein is incorporated herein by reference in their entirety.

SEQUENCE LISTING (1948 sequences)

SEQ ID NO: 1 - protein, 9 aa, Artificial Sequence
  Description of Artificial Sequence: Synthetic gluten peptide
  MOD_RES (3)..(3): I or L or V
  MOD_RES (5)..(5): F or Y or W
GZXPXPZPZ

SEQ ID NO: 2 - protein, 9 aa, Artificial Sequence
  Description of Artificial Sequence: Synthetic gluten peptide
  MOD_RES (2)..(2): I or L or V
  MOD_RES (4)..(4): F or Y or W
  MOD_RES (9)..(9): I or L or V
ZXPXPZPZX

SEQ ID NO: 3 - protein, 9 aa, Artificial Sequence
  Description of Artificial Sequence: Synthetic gluten peptide
  MOD_RES (4)..(4): F or Y or W
  MOD_RES (6)..(6): F or Y or W
ZZPXPXZPZ

SEQ ID NO: 4 - protein, 9 aa, Artificial Sequence
  Description of Artificial Sequence: Synthetic gluten peptide
  MOD_RES (1)..(1): F or Y or W
  MOD_RES (8)..(8): I or L or V
XPZPZZPXP

SEQ ID NO: 5 - protein, 9 aa, Artificial Sequence
  Description of Artificial Sequence: Synthetic gluten peptide
  MOD_RES (1)..(1): F or Y or W
  MOD_RES (8)..(8): F or Y or W
XPZPZZPXP

SEQ ID NO: 6 - protein, 9 aa, Artificial Sequence
  Description of Artificial Sequence: Synthetic gluten peptide
  MOD_RES (4)..(4): I or L or V
  MOD_RES (6)..(6): F or Y or W
ZPZXPXPZP

SEQ ID NO: 7 - protein, 9 aa, Artificial Sequence
  Description of Artificial Sequence: Synthetic gluten peptide
  MOD_RES (4)..(4): F or Y or W
  MOD_RES (9)..(9): I or L or V
ZZPXPZPZX

SEQ ID NO: 8 - protein, 9 aa, Artificial Sequence
  Description of Artificial Sequence: Synthetic gluten peptide
  MOD_RES (5)..(5): F or Y or W
  MOD_RES (6)..(6): S or T
PZZPXXZZG

SEQ ID NO: 9 - protein, 9 aa, Artificial Sequence
  Description of Artificial Sequence: Synthetic gluten peptide
  MOD_RES (2)..(2): F or Y or W
  MOD_RES (7)..(7): I or L or V
  MOD_RES (9)..(9): F or Y or W
GXPZPZXPX

SEQ ID NO: 10 - protein, 9 aa, Artificial Sequence
  Description of Artificial Sequence: Synthetic gluten peptide
  MOD_RES (9)..(9): F or Y or W
PZZZPZZPX

SEQ ID NO: 11 - protein, 9 aa, Artificial Sequence
  Description of Artificial Sequence: Synthetic gluten peptide
  MOD_RES (1)..(1): I or L or V
  MOD_RES (8)..(8): F or Y or W
XZZPZZPXP

SEQ ID NO: 12 - protein, 9 aa, Artificial Sequence
  Description of Artificial Sequence: Synthetic gluten peptide
  MOD_RES (6)..(6): F or Y or W
  MOD_RES (7)..(7): I or L or V
PZPZPXXPZ

SEQ ID NO: 13 - protein, 9 aa, Artificial Sequence
  Description of Artificial Sequence: Synthetic gluten peptide
  MOD_RES (3)..(3): I or L or V
  MOD_RES (4)..(4): S or T
  MOD_RES (9)..(9): I or L or V
ZZXXPCMDX

SEQ ID NO: 14 - protein, 9 aa, Artificial Sequence
  Description of Artificial Sequence: Synthetic gluten peptide
  MOD_RES (1)..(1): F or Y or W
  MOD_RES (6)..(6): F or Y or W
XZZZPXPZZ

SEQ ID NO: 15 - protein, 9 aa, Artificial Sequence
  Description of Artificial Sequence: Synthetic gluten peptide
  MOD_RES (3)..(3): F or Y or W
  MOD_RES (8)..(8): I or L or V
ZPXPZPZXP

SEQ ID NO: 16 - protein, 9 aa, Artificial Sequence
  Description of Artificial Sequence: Synthetic gluten peptide
  MOD_RES (8)..(8): F or Y or W
PZZPZZZXP

SEQ ID NO: 17 - protein, 9 aa, Artificial Sequence
  Description of Artificial Sequence: Synthetic gluten peptide
  MOD_RES (2)..(2): F or Y or W
  MOD_RES (3)..(3): S or T
  MOD_RES (9)..(9): I or L or V
PXXZZZZPX

SEQ ID NO: 18 - protein, 9 aa, Artificial Sequence
  Description of Artificial Sequence: Synthetic gluten peptide
  MOD_RES (5)..(5): S or T
  MOD_RES (7)..(7): I or L or V
PZZPXPXZP

SEQ ID NO: 19 - protein, 9 aa, Artificial Sequence
  Description of Artificial Sequence: Synthetic gluten peptide
  MOD_RES (6)..(6): I or L or V
  MOD_RES (8)..(8): I or L or V
ZPZZPXPXZ

SEQ ID NO: 20 - protein, 9 aa, Artificial Sequence
  Description of Artificial Sequence: Synthetic gluten peptide
  MOD_RES (7)..(7): I or L or V
  MOD_RES (9)..(9): F or Y or W
ZPZZPZXPX

SEQ ID NO: 21 - protein, 9 aa, Artificial Sequence
  Description of Artificial Sequence: Synthetic gluten peptide
  MOD_RES (4)..(4): I or L or V
  MOD_RES (6)..(6): F or Y or W
ZPZXPXPZG

SEQ ID NO: 22 - protein, 9 aa, Artificial Sequence
  Description of Artificial Sequence: Synthetic gluten peptide
  MOD_RES (1)..(1): F or Y or W
  MOD_RES (6)..(6): I or L or V
  MOD_RES (8)..(8): F or Y or W
XPZPZXPXG

SEQ ID NO: 23 - protein, 9 aa, Artificial Sequence
  Description of Artificial Sequence: Synthetic gluten peptide
  MOD_RES (5)..(5): F or Y or W
PZZPXCZZG

SEQ ID NO: 24 - protein, 9 aa, Artificial Sequence
  Description of Artificial Sequence: Synthetic gluten peptide
  MOD_RES (1)..(1): F or Y or W
  MOD_RES (8)..(8): F or Y or W
XPZPZZZXP

SEQ ID NO: 25 - protein, 9 aa, Artificial Sequence
  Description of Artificial Sequence: Synthetic gluten peptide
  MOD_RES (4)..(4): S or T
  MOD_RES (6)..(6): I or L or V
GZPXPXZPZ

SEQ ID NO: 26 - protein, 9 aa, Artificial Sequence
  Description of Artificial Sequence: Synthetic gluten peptide
  MOD_RES (1)..(1): F or Y or W
  MOD_RES (2)..(2): I or L or V
  MOD_RES (5)..(5): I or L or V
  MOD_RES (7)..(7): F or Y  or W
XXPZXPXPZ

SEQ ID NO: 27 - protein, 9 aa, Artificial Sequence
  Description of Artificial Sequence: Synthetic gluten peptide
  MOD_RES (1)..(1): F or Y or W
  MOD_RES (2)..(2): I or L or V
  MOD_RES (7)..(7): S or T
  MOD_RES (8)..(8): R or K or H
  MOD_RES (9)..(9): I or L or V
XXZZZCXXX

SEQ ID NO: 28 - protein, 9 aa, Artificial Sequence
  Description of Artificial Sequence: Synthetic gluten peptide
  MOD_RES (2)..(2): F or Y or W
  MOD_RES (9)..(9): F or Y or W
PXPZPZZPX

SEQ ID NO: 29 - protein, 9 aa, Artificial Sequence
  Description of Artificial Sequence: Synthetic gluten peptide
  MOD_RES (1)..(1): F or Y or W
  MOD_RES (2)..(2): I or L or V
  MOD_RES (8)..(8): F or Y or W
XXZPZZPXP

SEQ ID NO: 30 - protein, 9 aa, Artificial Sequence
  Description of Artificial Sequence: Synthetic gluten peptide
  MOD_RES (6)..(6): I or L or V
  MOD_RES (8)..(8): R or K or H
PZZZZXAXG

SEQ ID NO: 31 - protein, 9 aa, Artificial Sequence
  Description of Artificial Sequence: Synthetic gluten peptide
  MOD_RES (6)..(6): F or Y or W
ZPZZPXPZP

SEQ ID NO: 32 - protein, 9 aa, Artificial Sequence
  Description of Artificial Sequence: Synthetic gluten peptide
  MOD_RES (2)..(2): F or Y or W
  MOD_RES (4)..(4): I or L or V
PXPXZPZZP

SEQ ID NO: 33 - protein, 9 aa, Artificial Sequence
  Description of Artificial Sequence: Synthetic gluten peptide
  MOD_RES (6)..(6): F or Y or W
ZPZZAXPZP

SEQ ID NO: 34 - protein, 9 aa, Artificial Sequence
  Description of Artificial Sequence: Synthetic gluten peptide
  MOD_RES (3)..(3): F or Y or W
  MOD_RES (5)..(5): S or T
  MOD_RES (7)..(7): I or L or V
  MOD_RES (9)..(9): F or Y or W
PZXPXZXPX

SEQ ID NO: 35 - protein, 9 aa, Artificial Sequence
  Description of Artificial Sequence: Synthetic gluten peptide
  MOD_RES (2)..(2): F or Y or W
  MOD_RES (9)..(9): I or L or V
PXPZPZZZX

SEQ ID NO: 36 - protein, 9 aa, Artificial Sequence
  Description of Artificial Sequence: Synthetic gluten peptide
  MOD_RES (4)..(4): I or L or V
  MOD_RES (6)..(6): F or Y or W
PPZXPXPZP

SEQ ID NO: 37 - protein, 9 aa, Artificial Sequence
  Description of Artificial Sequence: Synthetic gluten peptide
  MOD_RES (3)..(3): I or L or V
  MOD_RES (6)..(6): F or Y or W
MZXZPXPZP

SEQ ID NO: 38 - protein, 9 aa, Artificial Sequence
  Description of Artificial Sequence: Synthetic gluten peptide
  MOD_RES (3)..(4): S or T
  MOD_RES (6)..(6): R or K or H
  MOD_RES (7)..(7): I or L or V
ZZXXCXXMZ

SEQ ID NO: 39 - protein, 9 aa, Artificial Sequence
  Description of Artificial Sequence: Synthetic gluten peptide
  MOD_RES (3)..(3): F or Y or W
  MOD_RES (4)..(4): S or T
ZZXXZPZZZ

SEQ ID NO: 40 - protein, 9 aa, Artificial Sequence
  Description of Artificial Sequence: Synthetic gluten peptide
  MOD_RES (5)..(5): F or Y or W
PZZZXPZPZ

SEQ ID NO: 41 - protein, 9 aa, Artificial Sequence
  Description of Artificial Sequence: Synthetic gluten peptide
  MOD_RES (2)..(2): I or L or V
  MOD_RES (5)..(5): I or L or V
  MOD_RES (8)..(8): R or K or H
PXPZXZPXN

SEQ ID NO: 42 - protein, 9 aa, Artificial Sequence
  Description of Artificial Sequence: Synthetic gluten peptide
  MOD_RES (1)..(2): S or T
  MOD_RES (4)..(4): I or L or V
  MOD_RES (5)..(5): S or T
  MOD_RES (7)..(7): I or L or V
  MOD_RES (9)..(9): R or K or H
XXCXXGXZX

SEQ ID NO: 43 - protein, 9 aa, Artificial Sequence
  Description of Artificial Sequence: Synthetic gluten peptide
  MOD_RES (1)..(1): F or Y or W
  MOD_RES (6)..(6): I or L or V
XZZZPXPPZ

SEQ ID NO: 44 - protein, 9 aa, Artificial Sequence
  Description of Artificial Sequence: Synthetic gluten peptide
  MOD_RES (3)..(3): I or L or V
  MOD_RES (8)..(8): S or T
  MOD_RES (9)..(9): F or Y or W
ZPXPZZPXX

SEQ ID NO: 45 - protein, 9 aa, Artificial Sequence
  Description of Artificial Sequence: Synthetic gluten peptide
  MOD_RES (1)..(2): I or L or V
  MOD_RES (3)..(3): F or Y or W
  MOD_RES (4)..(5): S or T
  MOD_RES (6)..(7): I or L or V
XXXXXXXZZ

SEQ ID NO: 46 - protein, 9 aa, Artificial Sequence
  Description of Artificial Sequence: Synthetic gluten peptide
  MOD_RES (3)..(4): I or L or V
  MOD_RES (5)..(5): S or T
ZPXXXZZPP

SEQ ID NO: 47 - protein, 9 aa, Artificial Sequence
  Description of Artificial Sequence: Synthetic gluten peptide
  MOD_RES (3)..(3): I or L or V
  MOD_RES (5)..(6): I or L or V
  MOD_RES (7)..(7): R or K or H
  MOD_RES (9)..(9): I or L or V
ZGXZXXXPX

SEQ ID NO: 48 - protein, 9 aa, Artificial Sequence
  Description of Artificial Sequence: Synthetic gluten peptide
  MOD_RES (2)..(2): F or Y or W
  MOD_RES (3)..(4): S or T
  MOD_RES (5)..(6): I or L or V
  MOD_RES (9)..(9): I or L or V
PXXXXXAGX

SEQ ID NO: 49 - protein, 9 aa, Artificial Sequence
  Description of Artificial Sequence: Synthetic gluten peptide
  MOD_RES (1)..(1): F or Y or W
  MOD_RES (3)..(5): S or T
  MOD_RES (6)..(6): I or L or V
  MOD_RES (9)..(9): I or L or V
XCXXXXAPX

SEQ ID NO: 50 - protein, 9 aa, Artificial Sequence
  Description of Artificial Sequence: Synthetic gluten peptide
  MOD_RES (1)..(1): R or K or H
  MOD_RES (2)..(2): I or L or V
  MOD_RES (5)..(5): S or T
  MOD_RES (7)..(7): R or K or H
  MOD_RES (8)..(8): I or L or V
XXAMXZXXA

SEQ ID NO: 51 - protein, 9 aa, Artificial Sequence
  Description of Artificial Sequence: Synthetic gluten peptide
  MOD_RES (4)..(4): S or T
  MOD_RES (5)..(5): F or Y or W
ZPZXXPPZZ

SEQ ID NO: 52 - protein, 9 aa, Artificial Sequence
  Description of Artificial Sequence: Synthetic gluten peptide
SIILQZQQQ

SEQ ID NO: 53 - protein, 9 aa, Artificial Sequence
  Description of Artificial Sequence: Synthetic gluten peptide
  MOD_RES (2)..(2): S or T
  MOD_RES (9)..(9): F or Y or W
ZXZZPZZPX

SEQ ID NO: 54 - protein, 9 aa, Artificial Sequence
  Description of Artificial Sequence: Synthetic gluten peptide
  MOD_RES (2)..(2): I or L or V
  MOD_RES (9)..(9): I or L or V
ZXZZPZZPX

SEQ ID NO: 55 - protein, 9 aa, Artificial Sequence
  Description of Artificial Sequence: Synthetic gluten peptide
  MOD_RES (1)..(1): I or L or V
  MOD_RES (9)..(9): F or Y or W
XPZZPZZPX

SEQ ID NO: 56 - protein, 9 aa, Artificial Sequence
  Description of Artificial Sequence: Synthetic gluten peptide
  MOD_RES (1)..(1): F or Y or W
  MOD_RES (9)..(9): F or Y or W
XPZZPZZPX

SEQ ID NO: 57 - protein, 9 aa, Artificial Sequence
  Description of Artificial Sequence: Synthetic gluten peptide
  MOD_RES (1)..(1): S or T
  MOD_RES (3)..(3): I or L or V
  MOD_RES (9)..(9): F or Y or W
XPXZPZZPX

SEQ ID NO: 58 - protein, 9 aa, Artificial Sequence
  Description of Artificial Sequence: Synthetic gluten peptide
  MOD_RES (2)..(2): F or Y or W
  MOD_RES (3)..(3): S or T
  MOD_RES (9)..(9): I or L or V
PXXZZPZZX

SEQ ID NO: 59 - protein, 9 aa, Artificial Sequence
  Description of Artificial Sequence: Synthetic gluten peptide
  MOD_RES (4)..(4): I or L or V
  MOD_RES (5)..(5): F or Y or W
GZZXXPZPZ

SEQ ID NO: 60 - protein, 9 aa, Artificial Sequence
  Description of Artificial Sequence: Synthetic gluten peptide
  MOD_RES (9)..(9): F or Y or W
ZPZZPZZPX

SEQ ID NO: 61 - protein, 9 aa, Artificial Sequence
  Description of Artificial Sequence: Synthetic gluten peptide
  MOD_RES (1)..(1): F or Y or W
  MOD_RES (9)..(9): I or L or V
XPZZPZZPX

SEQ ID NO: 62 - protein, 9 aa, Artificial Sequence
  Description of Artificial Sequence: Synthetic gluten peptide
  MOD_RES (2)..(3): S or T
  MOD_RES (8)..(8): F or Y or W
PXXZZPPXP

SEQ ID NO: 63 - protein, 9 aa, Artificial Sequence
  Description of Artificial Sequence: Synthetic gluten peptide
  MOD_RES (1)..(1): F or Y or W
  MOD_RES (7)..(7): I or L or V
  MOD_RES (9)..(9): F or Y or W
XPZZPZXPX

SEQ ID NO: 64 - protein, 9 aa, Artificial Sequence
  Description of Artificial Sequence: Synthetic gluten peptide
  MOD_RES (2)..(2): F or Y or W
  MOD_RES (4)..(4): F or Y or W
PXPXZPZZP

SEQ ID NO: 65 - protein, 9 aa, Artificial Sequence
  Description of Artificial Sequence: Synthetic gluten peptide
  MOD_RES (4)..(4): S or T
  MOD_RES (5)..(5): F or Y or W
  MOD_RES (7)..(7): R or K or H
PZZXXPXZG

SEQ ID NO: 66 - protein, 9 aa, Artificial Sequence
  Description of Artificial Sequence: Synthetic gluten peptide
  MOD_RES (1)..(1): S or T
  MOD_RES (2)..(2): F or Y or W
  MOD_RES (4)..(4): R or K or H
XXPXZPZZA

SEQ ID NO: 67 - protein, 9 aa, Artificial Sequence
  Description of Artificial Sequence: Synthetic gluten peptide
  MOD_RES (1)..(1): F or Y or W
  MOD_RES (2)..(2): S or T
  MOD_RES (7)..(7): S or T
  MOD_RES (8)..(8): F or Y or W
  MOD_RES (9)..(9): S or T
XXZZZPXXX

SEQ ID NO: 68 - protein, 9 aa, Artificial Sequence
  Description of Artificial Sequence: Synthetic gluten peptide
  MOD_RES (2)..(2): F or Y or W
  MOD_RES (8)..(8): S or T
  MOD_RES (9)..(9): F or Y or W
AXPZPZZXX

SEQ ID NO: 69 - protein, 9 aa, Artificial Sequence
  Description of Artificial Sequence: Synthetic gluten peptide
  MOD_RES (1)..(1): S or T
  MOD_RES (5)..(5): F or Y or W
  MOD_RES (6)..(6): S or T
XZZPXXZPZ

SEQ ID NO: 70 - protein, 9 aa, Artificial Sequence
  Description of Artificial Sequence: Synthetic gluten peptide
  MOD_RES (1)..(1): I or L or V
  MOD_RES (4)..(4): F or Y or W
XZPXPZPZP

SEQ ID NO: 71 - protein, 9 aa, Artificial Sequence
  Description of Artificial Sequence: Synthetic gluten peptide
  MOD_RES (2)..(2): F or Y or W
  MOD_RES (4)..(4): R or K or H
  MOD_RES (7)..(7): I or L or V
  MOD_RES (9)..(9): F or Y or W
PXPXPZXPX

SEQ ID NO: 72 - protein, 9 aa, Artificial Sequence
  Description of Artificial Sequence: Synthetic gluten peptide
  MOD_RES (3)..(3): I or L or V
  MOD_RES (4)..(4): F or Y or W
ZZXXPZPZZ

SEQ ID NO: 73 - protein, 9 aa, Artificial Sequence
  Description of Artificial Sequence: Synthetic gluten peptide
  MOD_RES (5)..(5): S or T
  MOD_RES (6)..(6): F or Y or W
  MOD_RES (9)..(9): R or K or H
ZPZZXXPZX

SEQ ID NO: 74 - protein, 9 aa, Artificial Sequence
  Description of Artificial Sequence: Synthetic gluten peptide
  MOD_RES (1)..(1): F or Y or W
  MOD_RES (4)..(4): R or K or H
  MOD_RES (9)..(9): F or Y or W
XPZXPZZPX

SEQ ID NO: 75 - protein, 9 aa, Artificial Sequence
  Description of Artificial Sequence: Synthetic gluten peptide
  MOD_RES (1)..(1): I or L or V
  MOD_RES (4)..(4): F or Y or W
  MOD_RES (9)..(9): I or L or V
XZPXPZPZX

SEQ ID NO: 76 - protein, 9 aa, Artificial Sequence
  Description of Artificial Sequence: Synthetic gluten peptide
  MOD_RES (3)..(3): F or Y or W
  MOD_RES (6)..(6): S or T
  MOD_RES (9)..(9): S or T
ZPXPZXZZX

SEQ ID NO: 77 - protein, 9 aa, Artificial Sequence
  Description of Artificial Sequence: Synthetic gluten peptide
  MOD_RES (2)..(3): S or T
  MOD_RES (5)..(5): I or L or V
  MOD_RES (8)..(8): I or L or V
ZXXCXPGXZ

SEQ ID NO: 78 - protein, 9 aa, Artificial Sequence
  Description of Artificial Sequence: Synthetic gluten peptide
  MOD_RES (2)..(3): I or L or V
  MOD_RES (5)..(5): R or K or H
  MOD_RES (9)..(9): F or Y or W
PXXPXGPPX

SEQ ID NO: 79 - protein, 9 aa, Artificial Sequence
  Description of Artificial Sequence: Synthetic gluten peptide
  MOD_RES (6)..(6): F or Y or W
ZPZZZXPZP

SEQ ID NO: 80 - protein, 9 aa, Artificial Sequence
  Description of Artificial Sequence: Synthetic gluten peptide
  MOD_RES (7)..(7): S or T
NMZADPXGZ

SEQ ID NO: 81 - protein, 9 aa, Artificial Sequence
  Description of Artificial Sequence: Synthetic gluten peptide
  MOD_RES (3)..(3): I or L or V
  MOD_RES (5)..(6): S or T
  MOD_RES (7)..(7): I or L or V
  MOD_RES (8)..(8): S or T
GAXCXXXXN

SEQ ID NO: 82 - protein, 9 aa, Artificial Sequence
  Description of Artificial Sequence: Synthetic gluten peptide
  MOD_RES (2)..(2): F or Y or W
  MOD_RES (7)..(7): I or L or V
  MOD_RES (9)..(9): I or L or V
ZXPZZZXPX

SEQ ID NO: 83 - protein, 9 aa, Artificial Sequence
  Description of Artificial Sequence: Synthetic gluten peptide
  MOD_RES (5)..(7): I or L or V
ZZZPXXXZZ

SEQ ID NO: 84 - protein, 9 aa, Artificial Sequence
  Description of Artificial Sequence: Synthetic gluten peptide
  MOD_RES (1)..(1): S or T
  MOD_RES (7)..(7): S or T
  MOD_RES (8)..(8): F or Y or W
XZZPZZXXP

SEQ ID NO: 85 - protein, 9 aa, Artificial Sequence
  Description of Artificial Sequence: Synthetic gluten peptide
  MOD_RES (1)..(1): F or Y or W
  MOD_RES (2)..(3): R or K or H
  MOD_RES (8)..(8): S or T
  MOD_RES (9)..(9): F or Y or W
XXXZPZZXX

SEQ ID NO: 86 - protein, 9 aa, Artificial Sequence
  Description of Artificial Sequence: Synthetic gluten peptide
  MOD_RES (1)..(1): R or K or H
  MOD_RES (2)..(4): F or Y or W
  MOD_RES (6)..(7): S or T
  MOD_RES (9)..(9): R or K or H
XXXXPXXPX

SEQ ID NO: 87 - protein, 9 aa, Artificial Sequence
  Description of Artificial Sequence: Synthetic gluten peptide
  MOD_RES (1)..(1): R or K or H
  MOD_RES (7)..(7): F or Y or W
  MOD_RES (8)..(8): S or T
XZPZZZXXZ

SEQ ID NO: 88 - protein, 9 aa, Artificial Sequence
  Description of Artificial Sequence: Synthetic gluten peptide
  MOD_RES (1)..(1): S or T
  MOD_RES (2)..(2): I or L or V
  MOD_RES (5)..(6): I or L or V
XXZZXXZZZ

SEQ ID NO: 89 - protein, 9 aa, Artificial Sequence
  Description of Artificial Sequence: Synthetic gluten peptide
  MOD_RES (1)..(1): I or L or V
  MOD_RES (5)..(5): I or L or V
XZZPXPPZZ

SEQ ID NO: 90 - protein, 9 aa, Artificial Sequence
  Description of Artificial Sequence: Synthetic gluten peptide
  MOD_RES (2)..(2): I or L or V
  MOD_RES (3)..(3): S or T
  MOD_RES (7)..(7): S or T
PXXPZZXGZ

SEQ ID NO: 91 - protein, 9 aa, Artificial Sequence
  Description of Artificial Sequence: Synthetic gluten peptide
  MOD_RES (4)..(4): F or Y or W
PZPXPZPZP

SEQ ID NO: 92 - protein, 9 aa, Artificial Sequence
  Description of Artificial Sequence: Synthetic gluten peptide
  MOD_RES (5)..(5): F or Y or W
ZPZPXPZPZ

SEQ ID NO: 93 - protein, 9 aa, Artificial Sequence
  Description of Artificial Sequence: Synthetic gluten peptide
  MOD_RES (1)..(1): F or Y or W
  MOD_RES (8)..(8): S or T
  MOD_RES (9)..(9): F or Y or W
XPZZPZZXX

SEQ ID NO: 94 - protein, 9 aa, Artificial Sequence
  Description of Artificial Sequence: Synthetic gluten peptide
  MOD_RES (3)..(3): S or T
  MOD_RES (4)..(4): F or Y or W
  MOD_RES (5)..(5): S or T
ZZXXXZZPP

SEQ ID NO: 95 - protein, 9 aa, Artificial Sequence
  Description of Artificial Sequence: Synthetic gluten peptide
  MOD_RES (1)..(1): F or Y or W
  MOD_RES (6)..(6): F or Y or W
XPZZPXPZZ

SEQ ID NO: 96 - protein, 9 aa, Artificial Sequence
  Description of Artificial Sequence: Synthetic gluten peptide
  MOD_RES (3)..(4): S or T
  MOD_RES (8)..(8): I or L or V
  MOD_RES (9)..(9): S or T
ZPXXZZPXX

SEQ ID NO: 97 - protein, 9 aa, Artificial Sequence
  Description of Artificial Sequence: Synthetic gluten peptide
  MOD_RES (3)..(3): I or L or V
  MOD_RES (6)..(6): R or K or H
  MOD_RES (8)..(8): S or T
  MOD_RES (9)..(9): F or Y or W
ZPXZZXZXX

SEQ ID NO: 98 - protein, 9 aa, Artificial Sequence
  Description of Artificial Sequence: Synthetic gluten peptide
  MOD_RES (1)..(1): I or L or V
  MOD_RES (2)..(2): S or T
  MOD_RES (6)..(6): I or L or V
XXPZZXGZG

SEQ ID NO: 99 - protein, 9 aa, Artificial Sequence
  Description of Artificial Sequence: Synthetic gluten peptide
  MOD_RES (7)..(7): R or K or H
  MOD_RES (8)..(8): I or L or V
ZZZCCZXXP

SEQ ID NO: 100 - protein, 9 aa, Artificial Sequence
  Description of Artificial Sequence: Synthetic gluten peptide
  MOD_RES (8)..(9): F or Y or W
AGZGZZGXX

SEQ ID NO: 101 - protein, 9 aa, Artificial Sequence
  Description of Artificial Sequence: Synthetic gluten peptide
  MOD_RES (5)..(5): F or Y or W
ZZZPXPZPZ

SEQ ID NO: 102 - protein, 9 aa, Artificial Sequence
  Description of Artificial Sequence: Synthetic gluten peptide
  MOD_RES (2)..(2): I or L or V
  MOD_RES (4)..(4): F or Y or W
ZXZXPZZZZ

SEQ ID NO: 103 - protein, 9 aa, Artificial Sequence
  Description of Artificial Sequence: Synthetic gluten peptide
  MOD_RES (3)..(3): I or L or V
  MOD_RES (6)..(6): I or L or V
ZPXZZXCCZ

SEQ ID NO: 104 - protein, 9 aa, Artificial Sequence
  Description of Artificial Sequence: Synthetic gluten peptide
  MOD_RES (2)..(2): F or Y or W
  MOD_RES (7)..(7): F or Y or W
  MOD_RES (9)..(9): S or T
PXPZPZXPX

SEQ ID NO: 105 - protein, 9 aa, Artificial Sequence
  Description of Artificial Sequence: Synthetic gluten peptide
  MOD_RES (2)..(2): I or L or V
  MOD_RES (4)..(4): S or T
  MOD_RES (5)..(5): I or L or V
  MOD_RES (7)..(7): S or T
AXZXXPXMC

SEQ ID NO: 106 - protein, 9 aa, Artificial Sequence
  Description of Artificial Sequence: Synthetic gluten peptide
  MOD_RES (1)..(1): R or K or H
  MOD_RES (2)..(2): I or L or V
  MOD_RES (3)..(3): F or Y or W
  MOD_RES (5)..(5): I or L or V
  MOD_RES (8)..(8): R or K or H
  MOD_RES (9)..(9): I or L or V
XXXZXPZXX

SEQ ID NO: 107 - protein, 9 aa, Artificial Sequence
  Description of Artificial Sequence: Synthetic gluten peptide
  MOD_RES (2)..(2): F or Y or W
  MOD_RES (5)..(5): S or T
  MOD_RES (8)..(8): S or T
  MOD_RES (9)..(9): F or Y or W
PXPZXZZXX

SEQ ID NO: 108 - protein, 9 aa, Artificial Sequence
  Description of Artificial Sequence: Synthetic gluten peptide
  MOD_RES (3)..(4): F or Y or W
  MOD_RES (7)..(7): S or T
ZGXXZPXZZ

SEQ ID NO: 109 - protein, 9 aa, Artificial Sequence
  Description of Artificial Sequence: Synthetic gluten peptide
  MOD_RES (2)..(2): S or T
  MOD_RES (3)..(3): I or L or V
  MOD_RES (4)..(4): F or Y or W
  MOD_RES (6)..(7): S or T
  MOD_RES (9)..(9): R or K or H
ZXXXZXXCX

SEQ ID NO: 110 - protein, 9 aa, Artificial Sequence
  Description of Artificial Sequence: Synthetic gluten peptide
  MOD_RES (1)..(1): I or L or V
  MOD_RES (2)..(3): S or T
  MOD_RES (4)..(4): I or L or V
  MOD_RES (5)..(5): F or Y or W
  MOD_RES (6)..(6): S or T
  MOD_RES (7)..(9): I or L or V
XXXXXXXXX

SEQ ID NO: 111 - protein, 9 aa, Artificial Sequence
  Description of Artificial Sequence: Synthetic gluten peptide
  MOD_RES (2)..(2): S or T
  MOD_RES (3)..(3): F or Y or W
  MOD_RES (9)..(9): S or T
ZXXPZPZZX

SEQ ID NO: 112 - protein, 9 aa, Artificial Sequence
  Description of Artificial Sequence: Synthetic gluten peptide
  MOD_RES (4)..(4): S or T
  MOD_RES (5)..(5): R or K or H
  MOD_RES (6)..(6): I or L or V
  MOD_RES (9)..(9): I or L or V
MZNXXXPGX

SEQ ID NO: 113 - protein, 9 aa, Artificial Sequence
  Description of Artificial Sequence: Synthetic gluten peptide
  MOD_RES (4)..(4): S or T
  MOD_RES (6)..(6): I or L or V
  MOD_RES (8)..(8): I or L or V
ZZCXPXAXP

SEQ ID NO: 114 - protein, 9 aa, Artificial Sequence
  Description of Artificial Sequence: Synthetic gluten peptide
  MOD_RES (2)..(2): F or Y or W
  MOD_RES (3)..(3): S or T
  MOD_RES (8)..(8): I or L or V
PXXZZZZXP

SEQ ID NO: 115 - protein, 9 aa, Artificial Sequence
  Description of Artificial Sequence: Synthetic gluten peptide
  MOD_RES (2)..(2): S or T
  MOD_RES (3)..(3): R or K or H
  MOD_RES (5)..(5): I or L or V
  MOD_RES (8)..(8): I or L or V
ZXXCXPGXZ

SEQ ID NO: 116 - protein, 9 aa, Artificial Sequence
  Description of Artificial Sequence: Synthetic gluten peptide
  MOD_RES (1)..(1): I or L or V
  MOD_RES (3)..(3): S or T
  MOD_RES (4)..(4): I or L or V
  MOD_RES (6)..(6): R or K or H
  MOD_RES (8)..(8): I or L or V
XPXXZXPXZ

SEQ ID NO: 117 - protein, 9 aa, Artificial Sequence
  Description of Artificial Sequence: Synthetic gluten peptide
  MOD_RES (3)..(3): I or L or V
  MOD_RES (5)..(5): F or Y or W
AZXPXPZZP

SEQ ID NO: 118 - protein, 9 aa, Artificial Sequence
  Description of Artificial Sequence: Synthetic gluten peptide
  MOD_RES (1)..(1): S or T
  MOD_RES (2)..(4): I or L or V
  MOD_RES (5)..(5): R or K or H
  MOD_RES (6)..(6): S or T
  MOD_RES (7)..(7): I or L or V
XXXXXXXPN

SEQ ID NO: 119 - protein, 9 aa, Artificial Sequence
  Description of Artificial Sequence: Synthetic gluten peptide
  MOD_RES (3)..(3): I or L or V
  MOD_RES (6)..(6): I or L or V
  MOD_RES (7)..(7): R or K or H
  MOD_RES (8)..(8): S or T
  MOD_RES (9)..(9): I or L or V
AZXZGXXXX

SEQ ID NO: 120 - protein, 9 aa, Artificial Sequence
  Description of Artificial Sequence: Synthetic gluten peptide
  MOD_RES (6)..(6): I or L or V
  MOD_RES (9)..(9): I or L or V
ZZPAZXZGX

SEQ ID NO: 121 - protein, 9 aa, Artificial Sequence
  Description of Artificial Sequence: Synthetic gluten peptide
  MOD_RES (1)..(1): S or T
  MOD_RES (3)..(3): I or L or V
  MOD_RES (8)..(8): R or K or H
  MOD_RES (9)..(9): I or L or V
XPXAMPZXX

SEQ ID NO: 122 - protein, 9 aa, Artificial Sequence
  Description of Artificial Sequence: Synthetic gluten peptide
  MOD_RES (2)..(2): I or L or V
  MOD_RES (6)..(6): R or K or H
  MOD_RES (8)..(8): F or Y or W
  MOD_RES (9)..(9): I or L or V
ZXNPCXNXX

SEQ ID NO: 123 - protein, 9 aa, Artificial Sequence
  Description of Artificial Sequence: Synthetic gluten peptide
  MOD_RES (1)..(1): I or L or V
  MOD_RES (6)..(6): I or L or V
  MOD_RES (9)..(9): I or L or V
XZPZZXAZX

SEQ ID NO: 124 - protein, 9 aa, Artificial Sequence
  Description of Artificial Sequence: Synthetic gluten peptide
  MOD_RES (2)..(2): F or Y or W
  MOD_RES (3)..(3): S or T
  MOD_RES (8)..(8): I or L or V
ZXXZZZZXP

SEQ ID NO: 125 - protein, 9 aa, Artificial Sequence
  Description of Artificial Sequence: Synthetic gluten peptide
  MOD_RES (1)..(1): F or Y or W
  MOD_RES (7)..(7): F or Y or W
XPZPZPXPP

SEQ ID NO: 126 - protein, 9 aa, Artificial Sequence
  Description of Artificial Sequence: Synthetic gluten peptide
  MOD_RES (1)..(1): F or Y or W
  MOD_RES (8)..(8): F or Y or W
XPZPZZPXC

SEQ ID NO: 127 - protein, 9 aa, Artificial Sequence
  Description of Artificial Sequence: Synthetic gluten peptide
  MOD_RES (3)..(3): I or L or V
  MOD_RES (6)..(6): I or L or V
ZZXPZXPZZ

SEQ ID NO: 128 - protein, 9 aa, Artificial Sequence
  Description of Artificial Sequence: Synthetic gluten peptide
  MOD_RES (4)..(4): S or T
  MOD_RES (7)..(8): I or L or V
PZZXZZXXP

SEQ ID NO: 129 - protein, 9 aa, Artificial Sequence
  Description of Artificial Sequence: Synthetic gluten peptide
  MOD_RES (5)..(5): S or T
  MOD_RES (7)..(7): S or T
  MOD_RES (9)..(9): R or K or H
PNNNXPXNX

SEQ ID NO: 130 - protein, 9 aa, Artificial Sequence
  Description of Artificial Sequence: Synthetic gluten peptide
  MOD_RES (9)..(9): R or K or H
MZZZZZZZX

SEQ ID NO: 131 - protein, 9 aa, Artificial Sequence
  Description of Artificial Sequence: Synthetic gluten peptide
  MOD_RES (7)..(7): R or K or H
  MOD_RES (9)..(9): F or Y or W
ZZMNPCXNX

SEQ ID NO: 132 - protein, 9 aa, Artificial Sequence
  Description of Artificial Sequence: Synthetic gluten peptide
  MOD_RES (3)..(3): I or L or V
  MOD_RES (5)..(5): I or L or V
  MOD_RES (7)..(7): I or L or V
  MOD_RES (8)..(8): F or Y or W
  MOD_RES (9)..(9): R or K or H
CNXNXPXXX

SEQ ID NO: 133 - protein, 9 aa, Artificial Sequence
  Description of Artificial Sequence: Synthetic gluten peptide
  MOD_RES (1)..(2): I or L  or V
  MOD_RES (3)..(3): S or T
  MOD_RES (4)..(6): I or L or V
  MOD_RES (8)..(8): R or K or H
  MOD_RES (9)..(9): S or T
XXXXXXPXX

SEQ ID NO: 134 - protein, 9 aa, Artificial Sequence
  Description of Artificial Sequence: Synthetic gluten peptide
  MOD_RES (2)..(2): I or L or V
  MOD_RES (5)..(5): I or L or V
  MOD_RES (9)..(9): S or T
ZXAZXPZZX

SEQ ID NO: 135 - protein, 9 aa, Artificial Sequence
  Description of Artificial Sequence: Synthetic gluten peptide
  MOD_RES (1)..(1): R or K or H
  MOD_RES (3)..(3): F or Y or W
  MOD_RES (4)..(4): I or L or V
  MOD_RES (8)..(8): I or L or V
XPXXZZPXP

SEQ ID NO: 136 - protein, 9 aa, Artificial Sequence
  Description of Artificial Sequence: Synthetic gluten peptide
  MOD_RES (2)..(2): F or Y or W
PXPZPZZPZ

SEQ ID NO: 137 - protein, 9 aa, Artificial Sequence
  Description of Artificial Sequence: Synthetic gluten peptide
  MOD_RES (1)..(1): F or Y or W
XPZPZZPZZ

SEQ ID NO: 138 - protein, 9 aa, Artificial Sequence
  Description of Artificial Sequence: Synthetic gluten peptide
  MOD_RES (3)..(3): I or L or V
  MOD_RES (6)..(6): I or L or V
ZZXZZXCCZ

SEQ ID NO: 139 - protein, 9 aa, Artificial Sequence
  Description of Artificial Sequence: Synthetic gluten peptide
  MOD_RES (4)..(4): S or T
  MOD_RES (5)..(5): F or Y or W
  MOD_RES (9)..(9): S or T
PZZXXPZZX

SEQ ID NO: 140 - protein, 9 aa, Artificial Sequence
  Description of Artificial Sequence: Synthetic gluten peptide
  MOD_RES (1)..(1): I or L or V
  MOD_RES (2)..(2): F or Y or W
  MOD_RES (9)..(9): F or Y or W
XXPZPZPZX

SEQ ID NO: 141 - protein, 9 aa, Artificial Sequence
  Description of Artificial Sequence: Synthetic gluten peptide
  MOD_RES (4)..(4): F or Y or W
ZZPXPZZPZ

SEQ ID NO: 142 - protein, 9 aa, Artificial Sequence
  Description of Artificial Sequence: Synthetic gluten peptide
  MOD_RES (2)..(2): I or L or V
  MOD_RES (5)..(5): I or L or V
  MOD_RES (7)..(7): I or L or V
  MOD_RES (9)..(9): S or T
ZXAZXZXMX

SEQ ID NO: 143 - protein, 9 aa, Artificial Sequence
  Description of Artificial Sequence: Synthetic gluten peptide
  MOD_RES (1)..(1): F or Y or W
  MOD_RES (3)..(3): I or L or V
  MOD_RES (7)..(7): S or T
XZXPZZXZC

SEQ ID NO: 144 - protein, 9 aa, Artificial Sequence
  Description of Artificial Sequence: Synthetic gluten peptide
  MOD_RES (4)..(4): S or T
  MOD_RES (8)..(8): I or L or V
ZZZXZZZXG

SEQ ID NO: 145 - protein, 9 aa, Artificial Sequence
  Description of Artificial Sequence: Synthetic gluten peptide
  MOD_RES (1)..(1): S or T
  MOD_RES (2)..(3): I or L or V
  MOD_RES (6)..(6): S or T
  MOD_RES (7)..(8): I or L or V
XXXZPXXXZ

SEQ ID NO: 146 - protein, 9 aa, Artificial Sequence
  Description of Artificial Sequence: Synthetic gluten peptide
  MOD_RES (1)..(1): F or Y or W
  MOD_RES (2)..(2): S or T
  MOD_RES (4)..(6): S or T
  MOD_RES (7)..(7): I or L or V
  MOD_RES (8)..(8): R or K or H
  MOD_RES (9)..(9): F or Y or W
XXAXXXXXX

SEQ ID NO: 147 - protein, 9 aa, Artificial Sequence
  Description of Artificial Sequence: Synthetic gluten peptide
  MOD_RES (1)..(1): R or K or H
  MOD_RES (9)..(9): I or L or V
XZZZZZZZX

SEQ ID NO: 148 - protein, 9 aa, Artificial Sequence
  Description of Artificial Sequence: Synthetic gluten peptide
  MOD_RES (1)..(2): I or L or V
  MOD_RES (6)..(6): I or L or V
  MOD_RES (7)..(7): S or T
XXZZZXXPC

SEQ ID NO: 149 - protein, 9 aa, Artificial Sequence
  Description of Artificial Sequence: Synthetic gluten peptide
  MOD_RES (3)..(4): I or L or V
  MOD_RES (9)..(9): I or L or V
ZZXXPZZZX

SEQ ID NO: 150 - protein, 9 aa, Artificial Sequence
  Description of Artificial Sequence: Synthetic gluten peptide
  MOD_RES (1)..(1): F or Y or W
  MOD_RES (2)..(2): S or T
  MOD_RES (8)..(8): F or Y or W
XXZZZZPXP

SEQ ID NO: 151 - protein, 9 aa, Artificial Sequence
  Description of Artificial Sequence: Synthetic gluten peptide
  MOD_RES (2)..(2): I or L or V
  MOD_RES (5)..(5): I or L or V
  MOD_RES (7)..(7): R or K or H
  MOD_RES (9)..(9): F or Y or W
CXPGXZXPX

SEQ ID NO: 152 - protein, 9 aa, Artificial Sequence
  Description of Artificial Sequence: Synthetic gluten peptide
  MOD_RES (5)..(5): I or L or V
  MOD_RES (7)..(7): I or L or V
ZZZCXPXAM

SEQ ID NO: 153 - protein, 9 aa, Artificial Sequence
  Description of Artificial Sequence: Synthetic gluten peptide
  MOD_RES (2)..(2): I or L or V
  MOD_RES (5)..(5): I or L or V
  MOD_RES (9)..(9): I or L or V
ZXAZXPRZX

SEQ ID NO: 154 - protein, 9 aa, Artificial Sequence
  Description of Artificial Sequence: Synthetic gluten peptide
  MOD_RES (4)..(4): R or K or H
  MOD_RES (6)..(6): F or Y or W
ZZPXZXPZZ

SEQ ID NO: 155 - protein, 9 aa, Artificial Sequence
  Description of Artificial Sequence: Synthetic gluten peptide
  MOD_RES (1)..(1): R or K or H
  MOD_RES (4)..(4): F or Y or W
  MOD_RES (5)..(5): I or L or V
XPMXXZPZZ

SEQ ID NO: 156 - protein, 9 aa, Artificial Sequence
  Description of Artificial Sequence: Synthetic gluten peptide
  MOD_RES (1)..(1): I or L or V
  MOD_RES (9)..(9): R or K or H
XZZZMNPCX

SEQ ID NO: 157 - protein, 9 aa, Artificial Sequence
  Description of Artificial Sequence: Synthetic gluten peptide
  MOD_RES (1)..(1): S or T
  MOD_RES (2)..(2): R or K or H
  MOD_RES (3)..(4): I or L or V
  MOD_RES (5)..(5): S or T
  MOD_RES (7)..(7): R or K or H
  MOD_RES (9)..(9): R or K or H
XXXXXPXGX

SEQ ID NO: 158 - protein, 9 aa, Artificial Sequence
  Description of Artificial Sequence: Synthetic gluten peptide
  MOD_RES (1)..(1): R or K or H
XZZZZZZZP

SEQ ID NO: 159 - protein, 9 aa, Artificial Sequence
  Description of Artificial Sequence: Synthetic gluten peptide
  MOD_RES (4)..(4): I or L or V
DCZXMZZZC

SEQ ID NO: 160 - protein, 9 aa, Artificial Sequence
  Description of Artificial Sequence: Synthetic gluten peptide
  MOD_RES (1)..(1): S or T
  MOD_RES (5)..(5): I or L or V
  MOD_RES (7)..(7): F or Y or W
  MOD_RES (8)..(8): S or T
XZPZXPXXZ

SEQ ID NO: 161 - protein, 9 aa, Artificial Sequence
  Description of Artificial Sequence: Synthetic gluten peptide
  MOD_RES (2)..(2): I or L or V
  MOD_RES (4)..(4): F or Y or W
  MOD_RES (5)..(5): S or T
ZXPXXZZZZ

SEQ ID NO: 162 - protein, 9 aa, Artificial Sequence
  Description of Artificial Sequence: Synthetic gluten peptide
  MOD_RES (4)..(4): F or Y or W
  MOD_RES (6)..(6): I or L or V
ZZPXPXZPZ

SEQ ID NO: 163 - protein, 9 aa, Artificial Sequence
  Description of Artificial Sequence: Synthetic gluten peptide
  MOD_RES (1)..(1): R or K or H
  MOD_RES (2)..(2): F or Y or W
  MOD_RES (5)..(5): I or L or V
  MOD_RES (6)..(6): R or K or H
  MOD_RES (8)..(9): I or L or V
XXDAXXAXX

SEQ ID NO: 164 - protein, 9 aa, Artificial Sequence
  Description of Artificial Sequence: Synthetic gluten peptide
  MOD_RES (2)..(2): S or T
  MOD_RES (3)..(3): R or K or H
  MOD_RES (4)..(4): F or Y or W
  MOD_RES (7)..(7): I or L or V
  MOD_RES (8)..(8): R or K or H
ZXXXDAXXA

SEQ ID NO: 165 - protein, 9 aa, Artificial Sequence
  Description of Artificial Sequence: Synthetic gluten peptide
  MOD_RES (3)..(3): S or T
  MOD_RES (9)..(9): I or L or V
ZPXPZPZZX

SEQ ID NO: 166 - protein, 9 aa, Artificial Sequence
  Description of Artificial Sequence: Synthetic gluten peptide
  MOD_RES (1)..(1): S or T
  MOD_RES (2)..(2): I or L or V
  MOD_RES (3)..(3): R or K or H
  MOD_RES (7)..(8): I or L or V
XXXZZPXXP

SEQ ID NO: 167 - protein, 9 aa, Artificial Sequence
  Description of Artificial Sequence: Synthetic gluten peptide
  MOD_RES (3)..(3): F or Y or W
  MOD_RES (4)..(4): S or T
  MOD_RES (5)..(5): I or L or V
  MOD_RES (6)..(6): R or K or H
PPXXXXZZP

SEQ ID NO: 168 - protein, 9 aa, Artificial Sequence
  Description of Artificial Sequence: Synthetic gluten peptide
  MOD_RES (1)..(1): F or Y or W
  MOD_RES (3)..(5): I or L or V
XPXXXZZZZ

SEQ ID NO: 169 - protein, 9 aa, Artificial Sequence
  Description of Artificial Sequence: Synthetic gluten peptide
  MOD_RES (1)..(1): F or Y or W
  MOD_RES (2)..(2): S or T
  MOD_RES (9)..(9): F or Y or W
XXZZZZPPX

SEQ ID NO: 170 - protein, 9 aa, Artificial Sequence
  Description of Artificial Sequence: Synthetic gluten peptide
  MOD_RES (2)..(2): R or K or H
  MOD_RES (6)..(7): I or L or V
ZXZZPXXPZ

SEQ ID NO: 171 - protein, 9 aa, Artificial Sequence
  Description of Artificial Sequence: Synthetic gluten peptide
  MOD_RES (5)..(5): F or Y or W
  MOD_RES (6)..(6): S or T
  MOD_RES (9)..(9): S or T
ZZPPXXZZX

SEQ ID NO: 172 - protein, 9 aa, Artificial Sequence
  Description of Artificial Sequence: Synthetic gluten peptide
ZZZZZZZZP

SEQ ID NO: 173 - protein, 9 aa, Artificial Sequence
  Description of Artificial Sequence: Synthetic gluten peptide
  MOD_RES (8)..(8): F or Y or W
  MOD_RES (9)..(9): S or T
ZZZZZPPXX

SEQ ID NO: 174 - protein, 9 aa, Artificial Sequence
  Description of Artificial Sequence: Synthetic gluten peptide
  MOD_RES (2)..(2): S or T
  MOD_RES (3)..(3): I or L or V
  MOD_RES (6)..(6): S or T
  MOD_RES (7)..(8): I or L or V
PXXZPXXXZ

SEQ ID NO: 175 - protein, 9 aa, Artificial Sequence
  Description of Artificial Sequence: Synthetic gluten peptide
  MOD_RES (5)..(5): I or L or V
PZZZXGZZP

SEQ ID NO: 176 - protein, 9 aa, Artificial Sequence
  Description of Artificial Sequence: Synthetic gluten peptide
  MOD_RES (2)..(2): S or T
  MOD_RES (3)..(3): F or Y or W
CXXZZPZZZ

SEQ ID NO: 177 - protein, 9 aa, Artificial Sequence
  Description of Artificial Sequence: Synthetic gluten peptide
  MOD_RES (1)..(1): R or K or H
  MOD_RES (3)..(3): I or L or V
  MOD_RES (7)..(7): R or K or H
  MOD_RES (8)..(8): I or L or V
  MOD_RES (9)..(9): F or Y or W
XZXCCZXXX

SEQ ID NO: 178 - protein, 9 aa, Artificial Sequence
  Description of Artificial Sequence: Synthetic gluten peptide
  MOD_RES (1)..(1): I or L or V
  MOD_RES (6)..(7): I or L or V
XZZZPXXPZ

SEQ ID NO: 179 - protein, 9 aa, Artificial Sequence
  Description of Artificial Sequence: Synthetic gluten peptide
  MOD_RES (2)..(2): R or K or H
  MOD_RES (5)..(5): F or Y or W
  MOD_RES (6)..(6): S or T
ZXPPXXZZZ

SEQ ID NO: 180 - protein, 9 aa, Artificial Sequence
  Description of Artificial Sequence: Synthetic gluten peptide
  MOD_RES (2)..(2): I or L or V
  MOD_RES (3)..(3): F or Y or W
  MOD_RES (4)..(4): I or L or V
  MOD_RES (9)..(9): I or L or V
MXXXZZZCX

SEQ ID NO: 181 - protein, 9 aa, Artificial Sequence
  Description of Artificial Sequence: Synthetic gluten peptide
  MOD_RES (4)..(4): R or K or H
  MOD_RES (6)..(6): F or Y or W
  MOD_RES (7)..(7): I or L or V
ZZZXPXXZP

SEQ ID NO: 182 - protein, 9 aa, Artificial Sequence
  Description of Artificial Sequence: Synthetic gluten peptide
  MOD_RES (1)..(1): S or T
  MOD_RES (2)..(2): F or Y or W
  MOD_RES (5)..(5): I or L or V
  MOD_RES (9)..(9): I or L or V
XXPZXPGZX

SEQ ID NO: 183 - protein, 9 aa, Artificial Sequence
  Description of Artificial Sequence: Synthetic gluten peptide
  MOD_RES (1)..(1): I or L or V
  MOD_RES (5)..(6): I or L or V
  MOD_RES (9)..(9): I or L or V
XZZZXXPZX

SEQ ID NO: 184 - protein, 9 aa, Artificial Sequence
  Description of Artificial Sequence: Synthetic gluten peptide
  MOD_RES (3)..(3): F or Y or W
  MOD_RES (4)..(4): I or L or V
  MOD_RES (7)..(7): S or T
  MOD_RES (8)..(8): I or L or V
PPXXZPXXZ

SEQ ID NO: 185 - protein, 9 aa, Artificial Sequence
  Description of Artificial Sequence: Synthetic gluten peptide
  MOD_RES (1)..(2): I or L or V
  MOD_RES (8)..(8): F or Y or W
  MOD_RES (9)..(9): S or T
XXPZZPAXX

SEQ ID NO: 186 - protein, 9 aa, Artificial Sequence
  Description of Artificial Sequence: Synthetic gluten peptide
  MOD_RES (7)..(7): I or L or V
PZPZZZXPZ

SEQ ID NO: 187 - protein, 9 aa, Artificial Sequence
  Description of Artificial Sequence: Synthetic gluten peptide
  MOD_RES (2)..(2): S or T
  MOD_RES (7)..(7): I or L or V
GXANMZXDP

SEQ ID NO: 188 - protein, 9 aa, Artificial Sequence
  Description of Artificial Sequence: Synthetic gluten peptide
  MOD_RES (6)..(6): R or K or H
  MOD_RES (7)..(7): I or L or V
  MOD_RES (8)..(8): F or Y or W
  MOD_RES (9)..(9): I or L or V
ZZZGMXXXX

SEQ ID NO: 189 - protein, 9 aa, Artificial Sequence
  Description of Artificial Sequence: Synthetic gluten peptide
  MOD_RES (1)..(1): R or K or H
  MOD_RES (2)..(3): I or L or V
  MOD_RES (4)..(4): R or K or H
  MOD_RES (6)..(8): I or L or V
  MOD_RES (9)..(9): R or K or H
XXXXAXXXX

SEQ ID NO: 190 - protein, 9 aa, Artificial Sequence
  Description of Artificial Sequence: Synthetic gluten peptide
  MOD_RES (1)..(1): I or L or V
  MOD_RES (3)..(3): I or L or V
  MOD_RES (4)..(4): F or Y or W
  MOD_RES (6)..(9): S or T
XPXXGXXXX

SEQ ID NO: 191 - protein, 9 aa, Artificial Sequence
  Description of Artificial Sequence: Synthetic gluten peptide
  MOD_RES (4)..(4): I or L or V
PZZXGZZPZ

SEQ ID NO: 192 - protein, 9 aa, Artificial Sequence
  Description of Artificial Sequence: Synthetic gluten peptide
  MOD_RES (2)..(2): S or T
  MOD_RES (7)..(8): I or L or V
ZXGZZZXXZ

SEQ ID NO: 193 - protein, 9 aa, Artificial Sequence
  Description of Artificial Sequence: Synthetic gluten peptide
  MOD_RES (1)..(1): F or Y or W
  MOD_RES (5)..(5): I or L or V
  MOD_RES (7)..(7): F or Y or W
XPPZXPXPZ

SEQ ID NO: 194 - protein, 9 aa, Artificial Sequence
  Description of Artificial Sequence: Synthetic gluten peptide
  MOD_RES (2)..(2): S or T
  MOD_RES (4)..(4): I or L or V
  MOD_RES (9)..(9): R or K or H
CXPXAMPZX

SEQ ID NO: 195 - protein, 9 aa, Artificial Sequence
  Description of Artificial Sequence: Synthetic gluten peptide
  MOD_RES (4)..(4): S or T
DZZXGZGZZ

SEQ ID NO: 196 - protein, 9 aa, Artificial Sequence
  Description of Artificial Sequence: Synthetic gluten peptide
  MOD_RES (2)..(2): I or L or V
  MOD_RES (5)..(5): S or T
  MOD_RES (6)..(7): I or L or V
  MOD_RES (8)..(8): F or Y or W
ZXZZXXXXG

SEQ ID NO: 197 - protein, 9 aa, Artificial Sequence
  Description of Artificial Sequence: Synthetic gluten peptide
  MOD_RES (2)..(2): F or Y or W
  MOD_RES (3)..(3): S or T
  MOD_RES (7)..(7): I or L or V
  MOD_RES (9)..(9): I or L or V
PXXZZZXPX

SEQ ID NO: 198 - protein, 9 aa, Artificial Sequence
  Description of Artificial Sequence: Synthetic gluten peptide
  MOD_RES (1)..(2): S or T
  MOD_RES (3)..(3): R or K or H
  MOD_RES (4)..(4): I or L or V
  MOD_RES (7)..(7): I or L or V
  MOD_RES (9)..(9): R or K or H
XXXXPGXZX

SEQ ID NO: 199 - protein, 9 aa, Artificial Sequence
  Description of Artificial Sequence: Synthetic gluten peptide
  MOD_RES (1)..(1): S or T
  MOD_RES (2)..(2): I or L or V
  MOD_RES (4)..(4): I or L or V
  MOD_RES (5)..(5): R or K or H
  MOD_RES (6)..(6): S or T
  MOD_RES (7)..(7): I or L or V
XXAXXXXPM

SEQ ID NO: 200 - protein, 16 aa, Artificial Sequence
  Description of Artificial Sequence: Synthetic gluten peptide
GQLPYPQPZLPYPQPG

SEQ ID NO: 201 - protein, 16 aa, Artificial Sequence
  Description of Artificial Sequence: Synthetic gluten peptide
GQLPYPQPQLPYPQPG

SEQ ID NO: 202 - protein, 20 aa, Artificial Sequence
  Description of Artificial Sequence: Synthetic gluten peptide
YLQLQPFPQPQLPYPQPQLP

SEQ ID NO: 203 - protein, 20 aa, Artificial Sequence
  Description of Artificial Sequence: Synthetic gluten peptide
PQPFPPQLPYPQPQLPYPQP

SEQ ID NO: 204 - protein, 20 aa, Artificial Sequence
  Description of Artificial Sequence: Synthetic gluten peptide
PYMQLQPFPQPQLPYPQPQL

SEQ ID NO: 205 - protein, 17 aa, Artificial Sequence
  Description of Artificial Sequence: Synthetic gluten peptide
QLQPFPQPQLPYPQPQL

SEQ ID NO: 206 - protein, 16 aa, Artificial Sequence
  Description of Artificial Sequence: Synthetic gluten peptide
GQLPYPQPELPYPQPG

SEQ ID NO: 207 - protein, 16 aa, Artificial Sequence
  Description of Artificial Sequence: Synthetic gluten peptide
GQLPYPQPQLPYPQPG

SEQ ID NO: 208 - protein, 20 aa, Artificial Sequence
  Description of Artificial Sequence: Synthetic gluten peptide
PQPFPPQLPYPQPQLPYPQP

SEQ ID NO: 209 - protein, 20 aa, Artificial Sequence
  Description of Artificial Sequence: Synthetic gluten peptide
MQLQPFPQPQLPYPQPQLPY

SEQ ID NO: 210 - protein, 17 aa, Artificial Sequence
  Description of Artificial Sequence: Synthetic gluten peptide
QLQPFPQPELPYPQPQL

SEQ ID NO: 211 - protein, 20 aa, Artificial Sequence
  Description of Artificial Sequence: Synthetic gluten peptide
PQLPYPQPQLPYPQPQLPYP

SEQ ID NO: 212 - protein, 20 aa, Artificial Sequence
  Description of Artificial Sequence: Synthetic gluten peptide
PQLPYPQPQLPYPQPQPFRP

SEQ ID NO: 213 - protein, 20 aa, Artificial Sequence
  Description of Artificial Sequence: Synthetic gluten peptide
LQPFPQPELPYPQPELPYPF

SEQ ID NO: 214 - protein, 20 aa, Artificial Sequence
  Description of Artificial Sequence: Synthetic gluten peptide
LQLQPFPQPQLPYPQPQLPY

SEQ ID NO: 215 - protein, 20 aa, Artificial Sequence
  Description of Artificial Sequence: Synthetic gluten peptide
PQPFPPQLPYPQPQLPYPQP

SEQ ID NO: 216 - protein, 20 aa, Artificial Sequence
  Description of Artificial Sequence: Synthetic gluten peptide
QPFPQPQQPFPWQPQQPFPQ

SEQ ID NO: 217 - protein, 20 aa, Artificial Sequence
  Description of Artificial Sequence: Synthetic gluten peptide
PQQPQQPFPQPQQPFPWQPQ

SEQ ID NO: 218 - protein, 20 aa, Artificial Sequence
  Description of Artificial Sequence: Synthetic gluten peptide
QPFPQPQQPFPWQPQQPFPQ

SEQ ID NO: 219 - protein, 20 aa, Artificial Sequence
  Description of Artificial Sequence: Synthetic gluten peptide
QPFPQPQQPFPWQPQQPFPQ

SEQ ID NO: 220 - protein, 20 aa, Artificial Sequence
  Description of Artificial Sequence: Synthetic gluten peptide
QQPFPQQPQQPFPQPQQPIP

SEQ ID NO: 221 - protein, 20 aa, Artificial Sequence
  Description of Artificial Sequence: Synthetic gluten peptide
PQQPQQPFPQPQQPIPVQPQ

SEQ ID NO: 222 - protein, 20 aa, Artificial Sequence
  Description of Artificial Sequence: Synthetic gluten peptide
PQQPQQPFPQPQQPIPVQPQ

SEQ ID NO: 223 - protein, 16 aa, Artificial Sequence
  Description of Artificial Sequence: Synthetic gluten peptide
GQQPFPQPEQPIPVQG

SEQ ID NO: 224 - protein, 16 aa, Artificial Sequence
  Description of Artificial Sequence: Synthetic gluten peptide
GQQPFPQPQQPIPVQG

SEQ ID NO: 225 - protein, 20 aa, Artificial Sequence
  Description of Artificial Sequence: Synthetic gluten peptide
PQQPQQPFPQPQQPIPVQPQ

SEQ ID NO: 226 - protein, 20 aa, Artificial Sequence
  Description of Artificial Sequence: Synthetic gluten peptide
QPFPQPQQPFPWQPQQPFPQ

SEQ ID NO: 227 - protein, 20 aa, Artificial Sequence
  Description of Artificial Sequence: Synthetic gluten peptide
PQQPQQPFPQPQQPFPWQPQ

SEQ ID NO: 228 - protein, 20 aa, Artificial Sequence
  Description of Artificial Sequence: Synthetic gluten peptide
PQQPQQPQQPFPQPQQPFPW

SEQ ID NO: 229 - protein, 20 aa, Artificial Sequence
  Description of Artificial Sequence: Synthetic gluten peptide
QPFPQPQQPFPWQPQQPFPQ

SEQ ID NO: 230 - protein, 16 aa, Artificial Sequence
  Description of Artificial Sequence: Synthetic gluten peptide
GQQPFPQPEQPFPWQG

SEQ ID NO: 231 - protein, 16 aa, Artificial Sequence
  Description of Artificial Sequence: Synthetic gluten peptide
GQQPFPQPQQPFPWQG

SEQ ID NO: 232 - protein, 20 aa, Artificial Sequence
  Description of Artificial Sequence: Synthetic gluten peptide
PQQPQQPQQPFPQPQQPFPW

SEQ ID NO: 233 - protein, 20 aa, Artificial Sequence
  Description of Artificial Sequence: Synthetic gluten peptide
QPFPQPQQPFPWQPQQPFPQ

SEQ ID NO: 234 - protein, 17 aa, Artificial Sequence
  Description of Artificial Sequence: Synthetic gluten peptide
QPQQPFPQPEQPFPWQP

SEQ ID NO: 235 - protein, 17 aa, Artificial Sequence
  Description of Artificial Sequence: Synthetic gluten peptide
QPEQPFPQPEQPFPWQP

SEQ ID NO: 236 - protein, 17 aa, Artificial Sequence
  Description of Artificial Sequence: Synthetic gluten peptide
QPQQPFPQPQQPFPWQP

SEQ ID NO: 237 - protein, 17 aa, Artificial Sequence
  Description of Artificial Sequence: Synthetic gluten peptide
QPEQPFPQPQQPFPWQP

SEQ ID NO: 238 - protein, 20 aa, Artificial Sequence
  Description of Artificial Sequence: Synthetic gluten peptide
YLQLQPFPQPQLPYPQPQLP

SEQ ID NO: 239 - protein, 20 aa, Artificial Sequence
  Description of Artificial Sequence: Synthetic gluten peptide
PQPFPPQLPYPQPQLPYPQP

SEQ ID NO: 240 - protein, 20 aa, Artificial Sequence
  Description of Artificial Sequence: Synthetic gluten peptide
PYMQLQPFPQPQLPYPQPQL

SEQ ID NO: 241 - protein, 17 aa, Artificial Sequence
  Description of Artificial Sequence: Synthetic gluten peptide
QLQPFPQPQLPYPQPQL

SEQ ID NO: 242 - protein, 16 aa, Artificial Sequence
  Description of Artificial Sequence: Synthetic gluten peptide
GQLPYPQPELPYPQPG

SEQ ID NO: 243 - protein, 16 aa, Artificial Sequence
  Description of Artificial Sequence: Synthetic gluten peptide
GLQPFPQPELPYPQPG

SEQ ID NO: 244 - protein, 20 aa, Artificial Sequence
  Description of Artificial Sequence: Synthetic gluten peptide
LQLQPFPQPQLPYPQPQPFR

SEQ ID NO: 245 - protein, 17 aa, Artificial Sequence
  Description of Artificial Sequence: Synthetic gluten peptide
QLQPFPQPELPYPQPQP

SEQ ID NO: 246 - protein, 16 aa, Artificial Sequence
  Description of Artificial Sequence: Synthetic gluten peptide
GQLPYPQPQLPYPQPG

SEQ ID NO: 247 - protein, 20 aa, Artificial Sequence
  Description of Artificial Sequence: Synthetic gluten peptide
PQPFPPQLPYPQPQLPYPQP

SEQ ID NO: 248 - protein, 20 aa, Artificial Sequence
  Description of Artificial Sequence: Synthetic gluten peptide
LQLQPFPQPQLPYPQPQPFR

SEQ ID NO: 249 - protein, 33 aa, Artificial Sequence
  Description of Artificial Sequence: Synthetic gluten peptide
LQLQPFPQPELPYPQPELPYPQPELPYPQPQPF

SEQ ID NO: 250 - protein, 20 aa, Artificial Sequence
  Description of Artificial Sequence: Synthetic gluten peptide
MQLQPFPQPQLPYPQPQLPY

SEQ ID NO: 251 - protein, 16 aa, Artificial Sequence
  Description of Artificial Sequence: Synthetic gluten peptide
GLQPFPQPELPFPQPG

SEQ ID NO: 252 - protein, 17 aa, Artificial Sequence
  Description of Artificial Sequence: Synthetic gluten peptide
QLQPFPQPELPYPQPQL

SEQ ID NO: 253 - protein, 20 aa, Artificial Sequence
  Description of Artificial Sequence: Synthetic gluten peptide
PQLPYPQPQLPYPQPQLPYP

SEQ ID NO: 254 - protein, 17 aa, Artificial Sequence
  Description of Artificial Sequence: Synthetic gluten peptide
QLQPFPQPQLPYPQPQP

SEQ ID NO: 255 - protein, 16 aa, Artificial Sequence
  Description of Artificial Sequence: Synthetic gluten peptide
GLQPFPQPQLPYPQPG

SEQ ID NO: 256 - protein, 20 aa, Artificial Sequence
  Description of Artificial Sequence: Synthetic gluten peptide
PQLPYPQPQLPYPQPQPFRP

SEQ ID NO: 257 - protein, 20 aa, Artificial Sequence
  Description of Artificial Sequence: Synthetic gluten peptide
LQPFPQPELPYPQPELPYPF

SEQ ID NO: 258 - protein, 20 aa, Artificial Sequence
  Description of Artificial Sequence: Synthetic gluten peptide
LQLQPFPQPQLPYPQPQLPY

SEQ ID NO: 259 - protein, 16 aa, Artificial Sequence
  Description of Artificial Sequence: Synthetic gluten peptide
GLQPFPQPQLPFPQPG

SEQ ID NO: 260 - protein, 20 aa, Artificial Sequence
  Description of Artificial Sequence: Synthetic gluten peptide
PQPFPPQLPYPQPQLPYPQP

SEQ ID NO: 261 - protein, 20 aa, Artificial Sequence
  Description of Artificial Sequence: Synthetic gluten peptide
YPQPQLPYPQPQPFRPQQSY

SEQ ID NO: 262 - protein, 15 aa, Artificial Sequence
  Description of Artificial Sequence: Synthetic gluten peptide
GSGQPELPYPQPGSG

SEQ ID NO: 263 - protein, 33 aa, Artificial Sequence
  Description of Artificial Sequence: Synthetic gluten peptide
LQLQPFPQPQLPYPQPQLPYPQPQLPYPQPQPF

SEQ ID NO: 264 - protein, 20 aa, Artificial Sequence
  Description of Artificial Sequence: Synthetic gluten peptide
QQPQQPFPQPQLPFPQQSEQ

SEQ ID NO: 265 - protein, 20 aa, Artificial Sequence
  Description of Artificial Sequence: Synthetic gluten peptide
FPQQPQQPFPQPQLPFPQQS

SEQ ID NO: 266 - protein, 16 aa, Artificial Sequence
  Description of Artificial Sequence: Synthetic gluten peptide
GQQPFPQPEQPFSQQG

SEQ ID NO: 267 - protein, 16 aa, Artificial Sequence
  Description of Artificial Sequence: Synthetic gluten peptide
GQQPFPQPQQPFSQQG

SEQ ID NO: 268 - protein, 15 aa, Artificial Sequence
  Description of Artificial Sequence: Synthetic gluten peptide
GSGFPQPELPYPGSG

SEQ ID NO: 269 - protein, 20 aa, Artificial Sequence
  Description of Artificial Sequence: Synthetic gluten peptide
QPQLPFPQQPQQQPQQPFPQ

SEQ ID NO: 270 - protein, 16 aa, Artificial Sequence
  Description of Artificial Sequence: Synthetic gluten peptide
GQQPQQQPEQPFPQQG

SEQ ID NO: 271 - protein, 16 aa, Artificial Sequence
  Description of Artificial Sequence: Synthetic gluten peptide
GQQPQQQPQQPFPQQG

SEQ ID NO: 272 - protein, 20 aa, Artificial Sequence
  Description of Artificial Sequence: Synthetic gluten peptide
LQQPQQPFPQPQQQLPQPQQ

SEQ ID NO: 273 - protein, 20 aa, Artificial Sequence
  Description of Artificial Sequence: Synthetic gluten peptide
LQQPQQPFPQPQQQLPQPQQ

SEQ ID NO: 274 - protein, 20 aa, Artificial Sequence
  Description of Artificial Sequence: Synthetic gluten peptide
QPQQPFPQLQQPQQPFPQPQ

SEQ ID NO: 275 - protein, 20 aa, Artificial Sequence
  Description of Artificial Sequence: Synthetic gluten peptide
PFPQLQQPQQPFPQPQQQLP

SEQ ID NO: 276 - protein, 16 aa, Artificial Sequence
  Description of Artificial Sequence: Synthetic gluten peptide
GFPQLQQPEQPFPQQG

SEQ ID NO: 277 - protein, 16 aa, Artificial Sequence
  Description of Artificial Sequence: Synthetic gluten peptide
GFPQLQQPQQPFPQQG

SEQ ID NO: 278 - protein, 20 aa, Artificial Sequence
  Description of Artificial Sequence: Synthetic gluten peptide
LQPFPQPQPFLPQLPYPQPQ

SEQ ID NO: 279 - protein, 20 aa, Artificial Sequence
  Description of Artificial Sequence: Synthetic gluten peptide
LQLQPFPQPQPFLPQLPYPQ

SEQ ID NO: 280 - protein, 20 aa, Artificial Sequence
  Description of Artificial Sequence: Synthetic gluten peptide
LQQILQQQLTPCMDVVLQQH

SEQ ID NO: 281 - protein, 20 aa, Artificial Sequence
  Description of Artificial Sequence: Synthetic gluten peptide
ILQQILQQQLTPCMDVVLQQ

SEQ ID NO: 282 - protein, 20 aa, Artificial Sequence
  Description of Artificial Sequence: Synthetic gluten peptide
QSPQQSFSYQQQPFPQQPYP

SEQ ID NO: 283 - protein, 20 aa, Artificial Sequence
  Description of Artificial Sequence: Synthetic gluten peptide
YQQQPFPQQPYPQQPYPSQQ

SEQ ID NO: 284 - protein, 20 aa, Artificial Sequence
  Description of Artificial Sequence: Synthetic gluten peptide
PQQSFSYQQQPFPQQPYPQQ

SEQ ID NO: 285 - protein, 20 aa, Artificial Sequence
  Description of Artificial Sequence: Synthetic gluten peptide
YLQLQPFPQPQLPYPQPQLP

SEQ ID NO: 286 - protein, 20 aa, Artificial Sequence
  Description of Artificial Sequence: Synthetic gluten peptide
PYMQLQPFPQPQLPYPQPQL

SEQ ID NO: 287 - protein, 17 aa, Artificial Sequence
  Description of Artificial Sequence: Synthetic gluten peptide
QLQPFPQPQLPYPQPQL

SEQ ID NO: 288 - protein, 16 aa, Artificial Sequence
  Description of Artificial Sequence: Synthetic gluten peptide
GLQPFPQPELPYPQPG

SEQ ID NO: 289 - protein, 20 aa, Artificial Sequence
  Description of Artificial Sequence: Synthetic gluten peptide
LQLQPFPQPQLPYPQPQPFR

SEQ ID NO: 290 - protein, 17 aa, Artificial Sequence
  Description of Artificial Sequence: Synthetic gluten peptide
QLQPFPQPELPYPQPQP

SEQ ID NO: 291 - protein, 20 aa, Artificial Sequence
  Description of Artificial Sequence: Synthetic gluten peptide
LQLQPFPQPQLPYPQPQPFR

SEQ ID NO: 292 - protein, 33 aa, Artificial Sequence; identical to SEQ ID NO: 249
  Description of Artificial Sequence: Synthetic gluten peptide

SEQ ID NO: 293 - protein, 20 aa, Artificial Sequence
  Description of Artificial Sequence: Synthetic gluten peptide
MQLQPFPQPQLPYPQPQLPY

SEQ ID NO: 294 - protein, 16 aa, Artificial Sequence
  Description of Artificial Sequence: Synthetic gluten peptide
GLQPFPQPELPFPQPG

SEQ ID NO: 295 - protein, 17 aa, Artificial Sequence
  Description of Artificial Sequence: Synthetic gluten peptide
QLQPFPQPELPYPQPQL

SEQ ID NO: 296 - protein, 17 aa, Artificial Sequence
  Description of Artificial Sequence: Synthetic gluten peptide
QLQPFPQPQLPYPQPQP

SEQ ID NO: 297 - protein, 16 aa, Artificial Sequence
  Description of Artificial Sequence: Synthetic gluten peptide
GLQPFPQPQLPYPQPG

SEQ ID NO: 298 - protein, 20 aa, Artificial Sequence
  Description of Artificial Sequence: Synthetic gluten peptide
LQPFPQPELPYPQPELPYPF

SEQ ID NO: 299 - protein, 20 aa, Artificial Sequence
  Description of Artificial Sequence: Synthetic gluten peptide
QQPQQPFPQPQLPFPQQSEQ

SEQ ID NO: 300 - protein, 20 aa, Artificial Sequence
  Description of Artificial Sequence: Synthetic gluten peptide
LQLQPFPQPQLPYPQPQLPY

SEQ ID NO: 301 - protein, 20 aa, Artificial Sequence
  Description of Artificial Sequence: Synthetic gluten peptide
FPQQPQQPFPQPQLPFPQQS

SEQ ID NO: 302 - protein, 16 aa, Artificial Sequence
  Description of Artificial Sequence: Synthetic gluten peptide
GLQPFPQPQLPFPQPG

SEQ ID NO: 303 - protein, 16 aa, Artificial Sequence
  Description of Artificial Sequence: Synthetic gluten peptide
GLQPFPQPELPYLQPG

SEQ ID NO: 304 - protein, 20 aa, Artificial Sequence
  Description of Artificial Sequence: Synthetic gluten peptide
PYLQLQPFPQPQLPYSQPQP

SEQ ID NO: 305 - protein, 16 aa, Artificial Sequence
  Description of Artificial Sequence: Synthetic gluten peptide
GLQPFPQPELPYSQPG

SEQ ID NO: 306 - protein, 20 aa, Artificial Sequence
  Description of Artificial Sequence: Synthetic gluten peptide
LQLQPFPQPQLPYLQPQPFR

SEQ ID NO: 307 - protein, 20 aa, Artificial Sequence
  Description of Artificial Sequence: Synthetic gluten peptide
LQLQPFPQPQLPYLQPQPFR

SEQ ID NO: 308 - protein, 20 aa, Artificial Sequence
  Description of Artificial Sequence: Synthetic gluten peptide
LQLQPFPQPQLPYSQPQPFR

SEQ ID NO: 309 - protein, 15 aa, Artificial Sequence
  Description of Artificial Sequence: Synthetic gluten peptide
GSGQPFPQPELPGSG

SEQ ID NO: 310 - protein, 33 aa, Artificial Sequence; identical to SEQ ID NO: 263
  Description of Artificial Sequence: Synthetic gluten peptide

SEQ ID NO: 311 - protein, 16 aa, Artificial Sequence
  Description of Artificial Sequence: Synthetic gluten peptide
GLQPFPQPQLPYSQPG

SEQ ID NO: 312 - protein, 20 aa, Artificial Sequence
  Description of Artificial Sequence: Synthetic gluten peptide
QPFPQPQLPYSQPQQFRPQQ

SEQ ID NO: 313 - protein, 20 aa, Artificial Sequence
  Description of Artificial Sequence: Synthetic gluten peptide
LQLQPFPQPQLPYSQPQQFR

SEQ ID NO: 314 - protein, 16 aa, Artificial Sequence
  Description of Artificial Sequence: Synthetic gluten peptide
GLQPFPQPQLPYLQPG

SEQ ID NO: 315 - protein, 20 aa, Artificial Sequence
  Description of Artificial Sequence: Synthetic gluten peptide
QFPSQLPYLQLQPFPQPQLP

SEQ ID NO: 316 - protein, 20 aa, Artificial Sequence
  Description of Artificial Sequence: Synthetic gluten peptide
PFPSQQPYMQLQPFPQPQLP

SEQ ID NO: 317 - protein, 20 aa, Artificial Sequence
  Description of Artificial Sequence: Synthetic gluten peptide
PFPSQLPYLQLQPFPQPQLP

SEQ ID NO: 318 - protein, 20 aa, Artificial Sequence
  Description of Artificial Sequence: Synthetic gluten peptide
PFPSQQPYLQLQPFPQPQLP

SEQ ID NO: 319 - protein, 20 aa, Artificial Sequence
  Description of Artificial Sequence: Synthetic gluten peptide
PFPSQQPYLQLQPFPQPQLP

SEQ ID NO: 320 - protein, 20 aa, Artificial Sequence
  Description of Artificial Sequence: Synthetic gluten peptide
PQQPFPQQPQQQFPQPQQPQ

SEQ ID NO: 321 - protein, 16 aa, Artificial Sequence
  Description of Artificial Sequence: Synthetic gluten peptide
GQPFPQQPEQEFPQPG

SEQ ID NO: 322 - protein, 20 aa, Artificial Sequence
  Description of Artificial Sequence: Synthetic gluten peptide
QQPQQPFPQQPQQQFPQPQQ

SEQ ID NO: 323 - protein, 16 aa, Artificial Sequence
  Description of Artificial Sequence: Synthetic gluten peptide
GQPFPQQPEQQFPQPG

SEQ ID NO: 324 - protein, 16 aa, Artificial Sequence
  Description of Artificial Sequence: Synthetic gluten peptide
GFPQQPEQEFPQPQQG

SEQ ID NO: 325 - protein, 20 aa, Artificial Sequence
  Description of Artificial Sequence: Synthetic gluten peptide
PQQPFPQQPQQQFPQPQQPQ

SEQ ID NO: 326 - protein, 16 aa, Artificial Sequence
  Description of Artificial Sequence: Synthetic gluten peptide
GFPQQPQQEFPQPQQG

SEQ ID NO: 327 - protein, 16 aa, Artificial Sequence
  Description of Artificial Sequence: Synthetic gluten peptide
GQPFPQQPQQQFPQPG

SEQ ID NO: 328 - protein, 20 aa, Artificial Sequence
  Description of Artificial Sequence: Synthetic gluten peptide
QQPQQPFPQQPQQQFPQPQQ

SEQ ID NO: 329 - protein, 20 aa, Artificial Sequence
  Description of Artificial Sequence: Synthetic gluten peptide
PQQPQQPFPQQPQQQFPQPQ

SEQ ID NO: 330 - protein, 16 aa, Artificial Sequence
  Description of Artificial Sequence: Synthetic gluten peptide
GFPQQPQQQFPQPQQG

SEQ ID NO: 331 - protein, 16 aa, Artificial Sequence
  Description of Artificial Sequence: Synthetic gluten peptide
GQPPFSQQEQPVLPQG

SEQ ID NO: 332 - protein, 20 aa, Artificial Sequence
  Description of Artificial Sequence: Synthetic gluten peptide
LQQSPFSQQQQPVLPQQQPV

SEQ ID NO: 333 - protein, 20 aa, Artificial Sequence
  Description of Artificial Sequence: Synthetic gluten peptide
PFSQQQQPPFSQQQQPVLPQ

SEQ ID NO: 334 - protein, 20 aa, Artificial Sequence
  Description of Artificial Sequence: Synthetic gluten peptide
QQQPILSQQPPFSQQQQPVL

SEQ ID NO: 335 - protein, 20 aa, Artificial Sequence
  Description of Artificial Sequence: Synthetic gluten peptide
QPPFSQQQQPVLPQQSPFSQ

SEQ ID NO: 336 - protein, 20 aa, Artificial Sequence
  Description of Artificial Sequence: Synthetic gluten peptide
QQQVLPQQPPFSQQQQPVLL

SEQ ID NO: 337 - protein, 20 aa, Artificial Sequence
  Description of Artificial Sequence: Synthetic gluten peptide
QQQPILSQQPPFSQQQQPVL

SEQ ID NO: 338 - protein, 20 aa, Artificial Sequence
  Description of Artificial Sequence: Synthetic gluten peptide
QQQPPFSQQQQPILPQQPPF

SEQ ID NO: 339 - protein, 20 aa, Artificial Sequence
  Description of Artificial Sequence: Synthetic gluten peptide
PFSQQQPPFSQQQQPILPQQ

SEQ ID NO: 340 - protein, 20 aa, Artificial Sequence
  Description of Artificial Sequence: Synthetic gluten peptide
QQQPILPQLPFSQQQQPVLP

SEQ ID NO: 341 - protein, 20 aa, Artificial Sequence
  Description of Artificial Sequence: Synthetic gluten peptide
QQPPFSQQQQPVLPPQQSPF

SEQ ID NO: 342 - protein, 16 aa, Artificial Sequence
  Description of Artificial Sequence: Synthetic gluten peptide
GQPPFSQQQQPVLPQG

SEQ ID NO: 343 - protein, 20 aa, Artificial Sequence
  Description of Artificial Sequence: Synthetic gluten peptide
QSPFSQQQQPVLPQQQPVII

SEQ ID NO: 344 - protein, 20 aa, Artificial Sequence
  Description of Artificial Sequence: Synthetic gluten peptide
QPPFSQQQQPVLPQQSPFSQ

SEQ ID NO: 345 - protein, 20 aa, Artificial Sequence
  Description of Artificial Sequence: Synthetic gluten peptide
QQQPPFSQQQQPVIPQQPSF

SEQ ID NO: 346 - protein, 20 aa, Artificial Sequence
  Description of Artificial Sequence: Synthetic gluten peptide
LPPFSQQLPPFSQQQQPVLP

SEQ ID NO: 347 - protein, 20 aa, Artificial Sequence
  Description of Artificial Sequence: Synthetic gluten peptide
QQQQPPFSQQQQPVLPQQSP

SEQ ID NO: 348 - protein, 20 aa, Artificial Sequence
  Description of Artificial Sequence: Synthetic gluten peptide
SQQQPILSQQPPFSQQQQPV

SEQ ID NO: 349 - protein, 20 aa, Artificial Sequence
  Description of Artificial Sequence: Synthetic gluten peptide
PFSQQQQPVLLQQQIPFVHP

SEQ ID NO: 350 - protein, 20 aa, Artificial Sequence
  Description of Artificial Sequence: Synthetic gluten peptide
FTQPQQPTPIQPQQPFPQQP

SEQ ID NO: 351 - protein, 20 aa, Artificial Sequence
  Description of Artificial Sequence: Synthetic gluten peptide
PFTQPQQPTPIQPQQPFPQQ

SEQ ID NO: 352 - protein, 20 aa, Artificial Sequence
  Description of Artificial Sequence: Synthetic gluten peptide
FPEQSQQPFTQPQQPTPIQP

SEQ ID NO: 353 - protein, 20 aa, Artificial Sequence
  Description of Artificial Sequence: Synthetic gluten peptide
PQQPQQPFPQPQQPIPVQPQ

SEQ ID NO: 354 - protein, 20 aa, Artificial Sequence
  Description of Artificial Sequence: Synthetic gluten peptide
PQQPQQPFPQPQQPIPVQPQ

SEQ ID NO: 355 - protein, 16 aa, Artificial Sequence
  Description of Artificial Sequence: Synthetic gluten peptide
GQQPFPQPEQPIPVQG

SEQ ID NO: 356 - protein, 16 aa, Artificial Sequence
  Description of Artificial Sequence: Synthetic gluten peptide
GQQPFPQPQQPIPVQG

SEQ ID NO: 357 - protein, 20 aa, Artificial Sequence
  Description of Artificial Sequence: Synthetic gluten peptide
PQQPQQPFPQPQQPIPVQPQ

SEQ ID NO: 358 - protein, 20 aa, Artificial Sequence
  Description of Artificial Sequence: Synthetic gluten peptide
PQPQQPIPVQPQQSFPQQSQ

SEQ ID NO: 359 - protein, 20 aa, Artificial Sequence
  Description of Artificial Sequence: Synthetic gluten peptide
QPQQPIPVQPQQSFPQQSQQ

SEQ ID NO: 360 - protein, 20 aa, Artificial Sequence
  Description of Artificial Sequence: Synthetic gluten peptide
QQPFPQPQQPQLPFPQQPQQ

SEQ ID NO: 361 - protein, 20 aa, Artificial Sequence
  Description of Artificial Sequence: Synthetic gluten peptide
QPQQPQQPFPQPQQPQLPFP

SEQ ID NO: 362 - protein, 20 aa, Artificial Sequence
  Description of Artificial Sequence: Synthetic gluten peptide
QQPQQPFPQPQQPQLPFPQQ

SEQ ID NO: 363 - protein, 20 aa, Artificial Sequence
  Description of Artificial Sequence: Synthetic gluten peptide
QQPQQPFPQPQQPQLPFPQQ

SEQ ID NO: 364 - protein, 20 aa, Artificial Sequence
  Description of Artificial Sequence: Synthetic gluten peptide
PQPQQPQLPFPQQPQQPFPQ

SEQ ID NO: 365 - protein, 20 aa, Artificial Sequence
  Description of Artificial Sequence: Synthetic gluten peptide
PQQPFPQPQQPQLPFPQQPQ

SEQ ID NO: 366 - protein, 16 aa, Artificial Sequence
  Description of Artificial Sequence: Synthetic gluten peptide
GQQPFPQPEQPQLPFG

SEQ ID NO: 367 - protein, 20 aa, Artificial Sequence
  Description of Artificial Sequence: Synthetic gluten peptide
QQPFPQPQQPQLPFPQQPQQ

SEQ ID NO: 368 - protein, 16 aa, Artificial Sequence
  Description of Artificial Sequence: Synthetic gluten peptide
GQQPFPQPQQPQLPFG

SEQ ID NO: 369 - protein, 16 aa, Artificial Sequence
  Description of Artificial Sequence: Synthetic gluten peptide
GFPQPQQPELPFPQQG

SEQ ID NO: 370 - protein, 16 aa, Artificial Sequence
  Description of Artificial Sequence: Synthetic gluten peptide
GFPQPQQPQLPFPQQG

SEQ ID NO: 371 - protein, 15 aa, Artificial Sequence
  Description of Artificial Sequence: Synthetic gluten peptide
GSGPQPELPYPQGSG

SEQ ID NO: 372 - protein, 15 aa, Artificial Sequence
  Description of Artificial Sequence: Synthetic gluten peptide
GSGPFPQPELPYGSG

SEQ ID NO: 373 - protein, 16 aa, Artificial Sequence
  Description of Artificial Sequence: Synthetic gluten peptide
GQQPFPQPEQPFCQQG

SEQ ID NO: 374 - protein, 16 aa, Artificial Sequence
  Description of Artificial Sequence: Synthetic gluten peptide
GQQPFPQPQQPFCQQG

SEQ ID NO: 375 - protein, 16 aa, Artificial Sequence
  Description of Artificial Sequence: Synthetic gluten peptide
GFFPQPEQEFPQPQQG

SEQ ID NO: 376 - protein, 16 aa, Artificial Sequence
  Description of Artificial Sequence: Synthetic gluten peptide
GQQPFPQPEQEFPQPG

SEQ ID NO: 377 - protein, 20 aa, Artificial Sequence
  Description of Artificial Sequence: Synthetic gluten peptide
SQQPQQPFPQPQQQFPQPQQ

SEQ ID NO: 378 - protein, 16 aa, Artificial Sequence
  Description of Artificial Sequence: Synthetic gluten peptide
GQQPFPQPEQQFPQPG

SEQ ID NO: 379 - protein, 20 aa, Artificial Sequence
  Description of Artificial Sequence: Synthetic gluten peptide
SQQPQQPFPQPQQQFPQPQQ

SEQ ID NO: 380 - protein, 20 aa, Artificial Sequence
  Description of Artificial Sequence: Synthetic gluten peptide
QPFPQPQQQFPQPQQPQQSF

SEQ ID NO: 381 - protein, 16 aa, Artificial Sequence
  Description of Artificial Sequence: Synthetic gluten peptide
GFFPQPQQEFPQPQQG

SEQ ID NO: 382 - protein, 20 aa, Artificial Sequence
  Description of Artificial Sequence: Synthetic gluten peptide
SQQPQQPFPQPQQQFPQPQQ

SEQ ID NO: 383 - protein, 16 aa, Artificial Sequence
  Description of Artificial Sequence: Synthetic gluten peptide
GFFPQPQQQFPQPQQG

SEQ ID NO: 384 - protein, 16 aa, Artificial Sequence
  Description of Artificial Sequence: Synthetic gluten peptide
GQQPFPQPQQQFPQPG

SEQ ID NO: 385 - protein, 16 aa, Artificial Sequence
  Description of Artificial Sequence: Synthetic gluten peptide
GQPTPIQPEQPFPQQG

SEQ ID NO: 386 - protein, 16 aa, Artificial Sequence
  Description of Artificial Sequence: Synthetic gluten peptide
GQPTPIQPQQPFPQQG

SEQ ID NO: 387 - protein, 20 aa, Artificial Sequence
  Description of Artificial Sequence: Synthetic gluten peptide
LQPFPQPQPFLPQLPYPQPQ

SEQ ID NO: 388 - protein, 20 aa, Artificial Sequence
  Description of Artificial Sequence: Synthetic gluten peptide
FLPQLPYPQPQSFPPQQPYP

SEQ ID NO: 389 - protein, 16 aa, Artificial Sequence
  Description of Artificial Sequence: Synthetic gluten peptide
GQPQPFLPELPYPQPG

SEQ ID NO: 390 - protein, 20 aa, Artificial Sequence
  Description of Artificial Sequence: Synthetic gluten peptide
PQPFLPQLPYPQPQSFPPQQ

SEQ ID NO: 391 - protein, 20 aa, Artificial Sequence
  Description of Artificial Sequence: Synthetic gluten peptide
PQPFLPQLPYPQPQSFPPQQ

SEQ ID NO: 392 - protein, 16 aa, Artificial Sequence
  Description of Artificial Sequence: Synthetic gluten peptide
GQPQPFLPQLPYPQPG

SEQ ID NO: 393 - protein, 20 aa, Artificial Sequence
  Description of Artificial Sequence: Synthetic gluten peptide
LQLQPFPQPQPFLPQLPYPQ

SEQ ID NO: 394 - protein, 20 aa, Artificial Sequence
  Description of Artificial Sequence: Synthetic gluten peptide
SVLQQLNPCKVFLQQQCSHV

SEQ ID NO: 395 - protein, 20 aa, Artificial Sequence
  Description of Artificial Sequence: Synthetic gluten peptide
KVFLQQQCSHVAMSQRLARP

SEQ ID NO: 396 - protein, 20 aa, Artificial Sequence
  Description of Artificial Sequence: Synthetic gluten peptide
QPFPQPQQPFPWQPQQPFPQ

SEQ ID NO: 397 - protein, 20 aa, Artificial Sequence
  Description of Artificial Sequence: Synthetic gluten peptide
PQQPQQPFPQPQQPFPWQPQ

SEQ ID NO: 398 - protein, 20 aa, Artificial Sequence
  Description of Artificial Sequence: Synthetic gluten peptide
PQQPQQPQQPFPQPQQPFPW

SEQ ID NO: 399 - protein, 20 aa, Artificial Sequence
  Description of Artificial Sequence: Synthetic gluten peptide
QPFPQPQQPFPWQPQQPFPQ

SEQ ID NO: 400 - protein, 16 aa, Artificial Sequence
  Description of Artificial Sequence: Synthetic gluten peptide
GQQPFPQPEQPFPWQG

SEQ ID NO: 401 - protein, 16 aa, Artificial Sequence
  Description of Artificial Sequence: Synthetic gluten peptide
GQQPFPQPQQPFPWQG

SEQ ID NO: 402 - protein, 20 aa, Artificial Sequence
  Description of Artificial Sequence: Synthetic gluten peptide
PQQPQQPQQPFPQPQQPFPW

SEQ ID NO: 403 - protein, 20 aa, Artificial Sequence
  Description of Artificial Sequence: Synthetic gluten peptide
QPFPQPQQPFPWQPQQPFPQ

SEQ ID NO: 404 - protein, 17 aa, Artificial Sequence
  Description of Artificial Sequence: Synthetic gluten peptide
QPQQPFPQPEQPFPWQP

SEQ ID NO: 405 - protein, 17 aa, Artificial Sequence
  Description of Artificial Sequence: Synthetic gluten peptide
QPEQPFPQPEQPFPWQP

SEQ ID NO: 406 - protein, 16 aa, Artificial Sequence
  Description of Artificial Sequence: Synthetic gluten peptide
GQQPFPQPEQPFSQQG

SEQ ID NO: 407 - protein, 16 aa, Artificial Sequence
  Description of Artificial Sequence: Synthetic gluten peptide
GQQPFPQPEQPFCQQG

SEQ ID NO: 408 - protein, 16 aa, Artificial Sequence
  Description of Artificial Sequence: Synthetic gluten peptide
GQQPFPQPQQPFSQQG

SEQ ID NO: 409 - protein, 20 aa, Artificial Sequence
  Description of Artificial Sequence: Synthetic gluten peptide
GQVQWPQQQPFPQPQQPFCE

SEQ ID NO: 410 - protein, 20 aa, Artificial Sequence
  Description of Artificial Sequence: Synthetic gluten peptide
PQQQQPFPQPQQPFSQQPQQ

SEQ ID NO: 411 - protein, 20 aa, Artificial Sequence
  Description of Artificial Sequence: Synthetic gluten peptide
WPQQQPFPQPQQPFCQQPQQ

SEQ ID NO: 412 - protein, 20 aa, Artificial Sequence
  Description of Artificial Sequence: Synthetic gluten peptide
PSGQVQWPQQQPFPQPQQPF

SEQ ID NO: 413 - protein, 16 aa, Artificial Sequence
  Description of Artificial Sequence: Synthetic gluten peptide
GQQPFPQPQQPFCQQG

SEQ ID NO: 414 - protein, 20 aa, Artificial Sequence
  Description of Artificial Sequence: Synthetic gluten peptide
PQQQPFPQPQQPFCEQPQRT

SEQ ID NO: 415 - protein, 17 aa, Artificial Sequence
  Description of Artificial Sequence: Synthetic gluten peptide
QPQQPFPQPQQPFPWQP

SEQ ID NO: 416 - protein, 17 aa, Artificial Sequence
  Description of Artificial Sequence: Synthetic gluten peptide
QPEQPFPQPQQPFPWQP

SEQ ID NO: 417 - protein, 20 aa, Artificial Sequence
  Description of Artificial Sequence: Synthetic gluten peptide
QQQPFPQPQQPFCQQPQRTI

SEQ ID NO: 418 - protein, 20 aa, Artificial Sequence
  Description of Artificial Sequence: Synthetic gluten peptide
QQQQPFPQPQQPFSQQPQQI

SEQ ID NO: 419 - protein, 20 aa, Artificial Sequence
  Description of Artificial Sequence: Synthetic gluten peptide
QQQPFPQPQQPFCEQPQRTI

SEQ ID NO: 420 - protein, 20 aa, Artificial Sequence
  Description of Artificial Sequence: Synthetic gluten peptide
QQFLQPQQPFPQQPQQPYPQ

SEQ ID NO: 421 - protein, 16 aa, Artificial Sequence
  Description of Artificial Sequence: Synthetic gluten peptide
GQQQFIQPEQPFPQQG

SEQ ID NO: 422 - protein, 20 aa, Artificial Sequence
  Description of Artificial Sequence: Synthetic gluten peptide
PQQQFIQPQQPFPQQPQQTY

SEQ ID NO: 423 - protein, 16 aa, Artificial Sequence
  Description of Artificial Sequence: Synthetic gluten peptide
GQQQFIQPQQPFPQQG

SEQ ID NO: 424 - protein, 20 aa, Artificial Sequence
  Description of Artificial Sequence: Synthetic gluten peptide
QQQFIQPQQPFPQQPQQTYP

SEQ ID NO: 425 - protein, 20 aa, Artificial Sequence
  Description of Artificial Sequence: Synthetic gluten peptide
FSQPQQPQQQFIQPQQPFPQ

SEQ ID NO: 426 - protein, 20 aa, Artificial Sequence
  Description of Artificial Sequence: Synthetic gluten peptide
PQQQFIQPQQPFPQQPQQTY

SEQ ID NO: 427 - protein, 20 aa, Artificial Sequence
  Description of Artificial Sequence: Synthetic gluten peptide
PQQPFLQPQQPFPQQPQQPF

SEQ ID NO: 428 - protein, 20 aa, Artificial Sequence
  Description of Artificial Sequence: Synthetic gluten peptide
PQQQFLQPQQPFPQQPRQPY

SEQ ID NO: 429 - protein, 20 aa, Artificial Sequence
  Description of Artificial Sequence: Synthetic gluten peptide
PQQQFLQPQQPFPQQPQQPY

SEQ ID NO: 430 - protein, 20 aa, Artificial Sequence
  Description of Artificial Sequence: Synthetic gluten peptide
GQQPQQQQLAHGTFLQPHKI

SEQ ID NO: 431 - protein, 20 aa, Artificial Sequence
  Description of Artificial Sequence: Synthetic gluten peptide
QQPQQQQLAHGTFLQPHQIA

SEQ ID NO: 432 - protein, 20 aa, Artificial Sequence
  Description of Artificial Sequence: Synthetic gluten peptide
PQQPQQPFPQPQQPFPWQPQ

SEQ ID NO: 433 - protein, 20 aa, Artificial Sequence
  Description of Artificial Sequence: Synthetic gluten peptide
PQQPQQPQQPFPQPQQPFPW

SEQ ID NO: 434 - protein, 20 aa, Artificial Sequence
  Description of Artificial Sequence: Synthetic gluten peptide
QQPFPQQPQQPFPQPQQPIP

SEQ ID NO: 435 - protein, 20 aa, Artificial Sequence
  Description of Artificial Sequence: Synthetic gluten peptide
PQQPQQPFPQPQQPIPVQPQ

SEQ ID NO: 436 - protein, 20 aa, Artificial Sequence
  Description of Artificial Sequence: Synthetic gluten peptide
PQQPQQPFPQPQQPIPVQPQ

SEQ ID NO: 437 - protein, 20 aa, Artificial Sequence
  Description of Artificial Sequence: Synthetic gluten peptide
PQQPQQPQQPFPQPQQPFPW

SEQ ID NO: 438 - protein, 20 aa, Artificial Sequence
  Description of Artificial Sequence: Synthetic gluten peptide
QQPQQPFPQPQLPFPQQSEQ

SEQ ID NO: 439 - protein, 17 aa, Artificial Sequence
  Description of Artificial Sequence: Synthetic gluten peptide
QPQQPFPQPEQPFPWQP

SEQ ID NO: 440 - protein, 20 aa, Artificial Sequence
  Description of Artificial Sequence: Synthetic gluten peptide
LQQPQQPFPQPQQQLPQPQQ

SEQ ID NO: 441 - protein, 17 aa, Artificial Sequence
  Description of Artificial Sequence: Synthetic gluten peptide
QPEQPFPQPEQPFPWQP

SEQ ID NO: 442 - protein, 20 aa, Artificial Sequence
  Description of Artificial Sequence: Synthetic gluten peptide
FPQQPQQPFPQPQLPFPQQS

SEQ ID NO: 443 - protein, 20 aa, Artificial Sequence
  Description of Artificial Sequence: Synthetic gluten peptide
PQQPQQPFPQPQQPIPVQPQ

SEQ ID NO: 444 - protein, 20 aa, Artificial Sequence
  Description of Artificial Sequence: Synthetic gluten peptide
PLQPQQPFPQQPQQPFPQPQ

SEQ ID NO: 445 - protein, 20 aa, Artificial Sequence
  Description of Artificial Sequence: Synthetic gluten peptide
SQQPQQPFPQPQQQFPQPQQ

SEQ ID NO: 446 - protein, 20 aa, Artificial Sequence
  Description of Artificial Sequence: Synthetic gluten peptide
SQQPQQPFPQPQQQFPQPQQ

SEQ ID NO: 447 - protein, 20 aa, Artificial Sequence
  Description of Artificial Sequence: Synthetic gluten peptide
PQQPFPQPQQPQQPFPQPQQ

SEQ ID NO: 448 - protein, 20 aa, Artificial Sequence
  Description of Artificial Sequence: Synthetic gluten peptide
QLPFPQQPQQPFPQPQQPQQ

SEQ ID NO: 449 - protein, 20 aa, Artificial Sequence
  Description of Artificial Sequence: Synthetic gluten peptide
HQPQQQFPQTQQPQQPFPQP

SEQ ID NO: 450 - protein, 20 aa, Artificial Sequence
  Description of Artificial Sequence: Synthetic gluten peptide
PQTQQPQQPFPQPQQTFPQQ

SEQ ID NO: 451 - protein, 20 aa, Artificial Sequence
  Description of Artificial Sequence: Synthetic gluten peptide
QPQQPQQPFPQPQQPQLPFP

SEQ ID NO: 452 - protein, 20 aa, Artificial Sequence
  Description of Artificial Sequence: Synthetic gluten peptide
PQQPFPQQPQQPQQPFPQPQ

SEQ ID NO: 453 - protein, 20 aa, Artificial Sequence
  Description of Artificial Sequence: Synthetic gluten peptide
QQPQQPFPQPQQPQLPFPQQ

SEQ ID NO: 454 - protein, 20 aa, Artificial Sequence
  Description of Artificial Sequence: Synthetic gluten peptide
SQQPQQPFPQPQQPQQSFPQ

SEQ ID NO: 455 - protein, 20 aa, Artificial Sequence
  Description of Artificial Sequence: Synthetic gluten peptide
QQQQPFPQPQQPQQPFPQPQ

SEQ ID NO: 456 - protein, 20 aa, Artificial Sequence
  Description of Artificial Sequence: Synthetic gluten peptide
QQPQQPFPQPQQPQLPFPQQ

SEQ ID NO: 457 - protein, 20 aa, Artificial Sequence
  Description of Artificial Sequence: Synthetic gluten peptide
PQQPQQPFPQPQQAQLPFPQ

SEQ ID NO: 458 - protein, 20 aa, Artificial Sequence
  Description of Artificial Sequence: Synthetic gluten peptide
LQQPQQPFPQPQQQLPQPQQ

SEQ ID NO: 459 - protein, 20 aa, Artificial Sequence
  Description of Artificial Sequence: Synthetic gluten peptide
QPQQPFPQSQQPQQPFPQPQ

SEQ ID NO: 460 - protein, 20 aa, Artificial Sequence
  Description of Artificial Sequence: Synthetic gluten peptide
QPQQPFPQLQQPQQPFPQPQ

SEQ ID NO: 461 - protein, 17 aa, Artificial Sequence
  Description of Artificial Sequence: Synthetic gluten peptide
QPQQPFPQPQQPFPWQP

SEQ ID NO: 462 - protein, 20 aa, Artificial Sequence
  Description of Artificial Sequence: Synthetic gluten peptide
SKQPQQPFPQPQQPQQSFPQ

SEQ ID NO: 463 - protein, 20 aa, Artificial Sequence
  Description of Artificial Sequence: Synthetic gluten peptide
SQQPQQPFPQPQQQFPQPQQ

SEQ ID NO: 464 - protein, 17 aa, Artificial Sequence
  Description of Artificial Sequence: Synthetic gluten peptide
QPEQPFPQPQQPFPWQP

SEQ ID NO: 465 - protein, 20 aa, Artificial Sequence
  Description of Artificial Sequence: Synthetic gluten peptide
PFPQLQQPQQPFPQPQQQLP

SEQ ID NO: 466 - protein, 20 aa, Artificial Sequence
  Description of Artificial Sequence: Synthetic gluten peptide
QSKQPQQPFPQPQQPQQSFP

SEQ ID NO: 467 - protein, 20 aa, Artificial Sequence
  Description of Artificial Sequence: Synthetic gluten peptide
FPLQPQQPFPQQPQQPFPQP

SEQ ID NO: 468 - protein, 20 aa, Artificial Sequence
  Description of Artificial Sequence: Synthetic gluten peptide
QQPQQQFPQPQQPQQPFPQP

SEQ ID NO: 469 - protein, 20 aa, Artificial Sequence
  Description of Artificial Sequence: Synthetic gluten peptide
QPQQPFPQSQQPQQPFPQPQ

SEQ ID NO: 470 - protein, 20 aa, Artificial Sequence
  Description of Artificial Sequence: Synthetic gluten peptide
QPQQPFPQSKQPQQPFPQPQ

SEQ ID NO: 471 - protein, 20 aa, Artificial Sequence
  Description of Artificial Sequence: Synthetic gluten peptide
PLQPQQPFPQQPQQPFPQPQ

SEQ ID NO: 472 - protein, 20 aa, Artificial Sequence
  Description of Artificial Sequence: Synthetic gluten peptide
QQFPQTQQPQQPFPQPQQTF

SEQ ID NO: 473 - protein, 20 aa, Artificial Sequence
  Description of Artificial Sequence: Synthetic gluten peptide
QQPQQPFPQSKQPQQPFPQP

SEQ ID NO: 474 - protein, 20 aa, Artificial Sequence
  Description of Artificial Sequence: Synthetic gluten peptide
PQQPQQPFPLQPQQPFPQQP

SEQ ID NO: 475 - protein, 16 aa, Artificial Sequence
  Description of Artificial Sequence: Synthetic gluten peptide
GQPFPLQPEQPFPQQG

SEQ ID NO: 476 - protein, 20 aa, Artificial Sequence
  Description of Artificial Sequence: Synthetic gluten peptide
PQQPQQPFPLQPQQPFPQQP

SEQ ID NO: 477 - protein, 16 aa, Artificial Sequence
  Description of Artificial Sequence: Synthetic gluten peptide
GQPFPLQPQQPFPQQG

SEQ ID NO: 478 - protein, 20 aa, Artificial Sequence
  Description of Artificial Sequence: Synthetic gluten peptide
PQQLQQPFPLQPQQPFPQQP

SEQ ID NO: 479 - protein, 20 aa, Artificial Sequence
  Description of Artificial Sequence: Synthetic gluten peptide
PQQPQQPFPLQPQQPFPQQP

SEQ ID NO: 480 - protein, 20 aa, Artificial Sequence
  Description of Artificial Sequence: Synthetic gluten peptide
SEQIIPQQLQQPFPLQPQQP

SEQ ID NO: 481 - protein, 16 aa, Artificial Sequence
  Description of Artificial Sequence: Synthetic gluten peptide
GQTFPHQPEQAFPQPG

SEQ ID NO: 482 - protein, 20 aa, Artificial Sequence
  Description of Artificial Sequence: Synthetic gluten peptide
QTFPHQPQQAFPQPQQTFPH

SEQ ID NO: 483 - protein, 16 aa, Artificial Sequence
  Description of Artificial Sequence: Synthetic gluten peptide
GQTFPHQPQQAFPQPG

SEQ ID NO: 484 - protein, 20 aa, Artificial Sequence
  Description of Artificial Sequence: Synthetic gluten peptide
PQQTFPHQPQQAFPQPQQTF

SEQ ID NO: 485 - protein, 20 aa, Artificial Sequence
  Description of Artificial Sequence: Synthetic gluten peptide
PPQQPYPQPQFPSQLPYLQL

SEQ ID NO: 486 - protein, 20 aa, Artificial Sequence
  Description of Artificial Sequence: Synthetic gluten peptide
QQPYPQPQFPSQLPYLQLQP

SEQ ID NO: 487 - protein, 20 aa, Artificial Sequence
  Description of Artificial Sequence: Synthetic gluten peptide
LQQPQQPFPQPQQQLPQPQQ

SEQ ID NO: 488 - protein, 16 aa, Artificial Sequence
  Description of Artificial Sequence: Synthetic gluten peptide
GQQPFPQPEQQLPQPG

SEQ ID NO: 489 - protein, 20 aa, Artificial Sequence
  Description of Artificial Sequence: Synthetic gluten peptide
LQQPQQPFPQPQQQLPQPQQ

SEQ ID NO: 490 - protein, 20 aa, Artificial Sequence
  Description of Artificial Sequence: Synthetic gluten peptide
PFPQLQQPQQPFPQPQQQLP

SEQ ID NO: 491 - protein, 16 aa, Artificial Sequence
  Description of Artificial Sequence: Synthetic gluten peptide
GQQPFPQPQQQLPQPG

SEQ ID NO: 492 - protein, 20 aa, Artificial Sequence
  Description of Artificial Sequence: Synthetic gluten peptide
QPFPQPQQQLPQPQQPQQSF

SEQ ID NO: 493 - protein, 20 aa, Artificial Sequence
  Description of Artificial Sequence: Synthetic gluten peptide
PQPFPPQLPYPQPQLPYPQP

SEQ ID NO: 494 - protein, 20 aa, Artificial Sequence
  Description of Artificial Sequence: Synthetic gluten peptide
PQPFPPQLPYPQPQLPYPQP

SEQ ID NO: 495 - protein, 20 aa, Artificial Sequence
  Description of Artificial Sequence: Synthetic gluten peptide
QPFPPQLPYPQPQPFRPQQP

SEQ ID NO: 496 - protein, 20 aa, Artificial Sequence
  Description of Artificial Sequence: Synthetic gluten peptide
PQPFPPQLPYPQPQLPYPQP

SEQ ID NO: 497 - protein, 20 aa, Artificial Sequence
  Description of Artificial Sequence: Synthetic gluten peptide
PQPFPPQLPYPQPQPFRPQQ

SEQ ID NO: 498 - protein, 20 aa, Artificial Sequence
  Description of Artificial Sequence: Synthetic gluten peptide
PQPFPPQLPYPQPPPFSPQQ

SEQ ID NO: 499 - protein, 20 aa, Artificial Sequence
  Description of Artificial Sequence: Synthetic gluten peptide
PQPFPPQLPYPQPQSFPPQQ

SEQ ID NO: 500 - protein, 16 aa, Artificial Sequence
  Description of Artificial Sequence: Synthetic gluten peptide
GQPQPFPPELPYPQPG

SEQ ID NO: 501 - protein, 16 aa, Artificial Sequence
  Description of Artificial Sequence: Synthetic gluten peptide
GQPQPFPPQLPYPQPG

SEQ ID NO: 502 - protein, 20 aa, Artificial Sequence
  Description of Artificial Sequence: Synthetic gluten peptide
PFPQPQPFPPQLPYPQPPPF

SEQ ID NO: 503 - protein, 15 aa, Artificial Sequence
  Description of Artificial Sequence: Synthetic gluten peptide
GSGPPELPYPQPGSG

SEQ ID NO: 504 - protein, 20 aa, Artificial Sequence
  Description of Artificial Sequence: Synthetic gluten peptide
PFPQPQPFPPQLPYPQPQSF

SEQ ID NO: 505 - protein, 20 aa, Artificial Sequence
  Description of Artificial Sequence: Synthetic gluten peptide
PQPFPPQLPYPQPPPFSPQQ

SEQ ID NO: 506 - protein, 20 aa, Artificial Sequence
  Description of Artificial Sequence: Synthetic gluten peptide
PYMQLQPFPQPQLPYPQPQL

SEQ ID NO: 507 - protein, 20 aa, Artificial Sequence
  Description of Artificial Sequence: Synthetic gluten peptide
MQLQPFPQPQLPYPQPQLPY

SEQ ID NO: 508 - protein, 20 aa, Artificial Sequence
  Description of Artificial Sequence: Synthetic gluten peptide
MQLQPFPQPQPFPPQLPYPQ

SEQ ID NO: 509 - protein, 20 aa, Artificial Sequence
  Description of Artificial Sequence: Synthetic gluten peptide
PFPSQQPYMQLQPFPQPQPF

SEQ ID NO: 510 - protein, 20 aa, Artificial Sequence
  Description of Artificial Sequence: Synthetic gluten peptide
PFPSQQPYMQLQPFPQPQLP

SEQ ID NO: 511 - protein, 20 aa, Artificial Sequence
  Description of Artificial Sequence: Synthetic gluten peptide
PFPSQQPYMQLQPFPQPQPF

SEQ ID NO: 512 - protein, 20 aa, Artificial Sequence
  Description of Artificial Sequence: Synthetic gluten peptide
PQRLARSQMWQQSSCHVMQQ

SEQ ID NO: 513 - protein, 20 aa, Artificial Sequence
  Description of Artificial Sequence: Synthetic gluten peptide
QGLARSQMLQQSSCHVMQQQ

SEQ ID NO: 514 - protein, 20 aa, Artificial Sequence
  Description of Artificial Sequence: Synthetic gluten peptide
PQRLARSQMWQQSSCHVMQQ

SEQ ID NO: 515 - protein, 20 aa, Artificial Sequence
  Description of Artificial Sequence: Synthetic gluten peptide
RLARSQMLQQSSCHVMQQQC

SEQ ID NO: 516 - protein, 20 aa, Artificial Sequence
  Description of Artificial Sequence: Synthetic gluten peptide
RPQMWQQSSCHVMQQQCCQQ

SEQ ID NO: 517 - protein, 20 aa, Artificial Sequence
  Description of Artificial Sequence: Synthetic gluten peptide
MWQQSSCHVMQQQCCQQLQQ

SEQ ID NO: 518 - protein, 20 aa, Artificial Sequence
  Description of Artificial Sequence: Synthetic gluten peptide
SQMLQQSSCHVMQQQCCQQL

SEQ ID NO: 519 - protein, 20 aa, Artificial Sequence
  Description of Artificial Sequence: Synthetic gluten peptide
QQSSCHVMQQQCCQQLQQIP

SEQ ID NO: 520 - protein, 20 aa, Artificial Sequence
  Description of Artificial Sequence: Synthetic gluten peptide
QQSSCHVMQQQCCQQLQQIP

SEQ ID NO: 521 - protein, 20 aa, Artificial Sequence
  Description of Artificial Sequence: Synthetic gluten peptide
RLARSQMWQQSSCHVMQQQC

SEQ ID NO: 522 - protein, 20 aa, Artificial Sequence
  Description of Artificial Sequence: Synthetic gluten peptide
ARSQMLQQSSCHVMQQQCCQ

SEQ ID NO: 523 - protein, 16 aa, Artificial Sequence
  Description of Artificial Sequence: Synthetic gluten peptide
GQQQFSQPEQEFPQPG

SEQ ID NO: 524 - protein, 16 aa, Artificial Sequence
  Description of Artificial Sequence: Synthetic gluten peptide
GQQQFSQPQQQFPQPG

SEQ ID NO: 525 - protein, 16 aa, Artificial Sequence
  Description of Artificial Sequence: Synthetic gluten peptide
GQQQFSQPEQQFPQPG

SEQ ID NO: 526 - protein, 20 aa, Artificial Sequence
  Description of Artificial Sequence: Synthetic gluten peptide
SQQPQQQFSQPQQQFPQPQQ

SEQ ID NO: 527 - protein, 20 aa, Artificial Sequence
  Description of Artificial Sequence: Synthetic gluten peptide
SQQPQQQFSQPQQQFPQPQQ

SEQ ID NO: 528 - protein, 15 aa, Artificial Sequence
  Description of Artificial Sequence: Synthetic gluten peptide
QQFSQPEQEFPQPQQ

SEQ ID NO: 529 - protein, 20 aa, Artificial Sequence
  Description of Artificial Sequence: Synthetic gluten peptide
QSQQPQQQFSQPQQQFPQPQ

SEQ ID NO: 530 - protein, 20 aa, Artificial Sequence
  Description of Artificial Sequence: Synthetic gluten peptide
QPQQQFSQPQQQFPQPQQPQ

SEQ ID NO: 531 - protein, 16 aa, Artificial Sequence
  Description of Artificial Sequence: Synthetic gluten peptide
GFFPQPEQEFPQPQQG

SEQ ID NO: 532 - protein, 20 aa, Artificial Sequence
  Description of Artificial Sequence: Synthetic gluten peptide
SQQPQQPFPQPQQQFPQPQQ

SEQ ID NO: 533 - protein, 20 aa, Artificial Sequence
  Description of Artificial Sequence: Synthetic gluten peptide
SQQPQQPFPQPQQQFPQPQQ

SEQ ID NO: 534 - protein, 20 aa, Artificial Sequence
  Description of Artificial Sequence: Synthetic gluten peptide
PQQPFPQQPQQQFPQPQQPQ

SEQ ID NO: 535 - protein, 20 aa, Artificial Sequence
  Description of Artificial Sequence: Synthetic gluten peptide
PQQQFPQPQQPQQPFPQQPQ

SEQ ID NO: 536 - protein, 20 aa, Artificial Sequence
  Description of Artificial Sequence: Synthetic gluten peptide
QPFPQPQQQFPQPQQPQQSF

SEQ ID NO: 537 - protein, 20 aa, Artificial Sequence
  Description of Artificial Sequence: Synthetic gluten peptide
QQPQQPFPQQPQQQFPQPQQ

SEQ ID NO: 538 - protein, 16 aa, Artificial Sequence
  Description of Artificial Sequence: Synthetic gluten peptide
GFFPQPQQEFPQPQQG

SEQ ID NO: 539 - protein, 20 aa, Artificial Sequence
  Description of Artificial Sequence: Synthetic gluten peptide
SQQPQQPFPQPQQQFPQPQQ

SEQ ID NO: 540 - protein, 16 aa, Artificial Sequence
  Description of Artificial Sequence: Synthetic gluten peptide
GFFPQPQQQFPQPQQG

SEQ ID NO: 541 - protein, 20 aa, Artificial Sequence
  Description of Artificial Sequence: Synthetic gluten peptide
QQPQQQFPQPQQPQQPFPQP

SEQ ID NO: 542 - protein, 16 aa, Artificial Sequence
  Description of Artificial Sequence: Synthetic gluten peptide
GFPQQPEQEFPQPQQG

SEQ ID NO: 543 - protein, 20 aa, Artificial Sequence
  Description of Artificial Sequence: Synthetic gluten peptide
PQQPFPQQPQQQFPQPQQPQ

SEQ ID NO: 544 - protein, 16 aa, Artificial Sequence
  Description of Artificial Sequence: Synthetic gluten peptide
GFFSQPQQEFPQPQQG

SEQ ID NO: 545 - protein, 20 aa, Artificial Sequence
  Description of Artificial Sequence: Synthetic gluten peptide
PQPQQQFPQPQQPQQSFPQQ

SEQ ID NO: 546 - protein, 16 aa, Artificial Sequence
  Description of Artificial Sequence: Synthetic gluten peptide
GFPQQPQQEFPQPQQG

SEQ ID NO: 547 - protein, 20 aa, Artificial Sequence
  Description of Artificial Sequence: Synthetic gluten peptide
SQQPQQQFSQPQQQFPQPQQ

SEQ ID NO: 548 - protein, 20 aa, Artificial Sequence
  Description of Artificial Sequence: Synthetic gluten peptide
SQQPQQQFSQPQQQFPQPQQ

SEQ ID NO: 549 - protein, 15 aa, Artificial Sequence
  Description of Artificial Sequence: Synthetic gluten peptide
QQFSQPEQEFPQPQQ

SEQ ID NO: 550 - protein, 20 aa, Artificial Sequence
  Description of Artificial Sequence: Synthetic gluten peptide
QSQQPQQQFSQPQQQFPQPQ

SEQ ID NO: 551 - protein, 20 aa, Artificial Sequence
  Description of Artificial Sequence: Synthetic gluten peptide
PQQQFPQPQQPQQPFPQQPQ

SEQ ID NO: 552 - protein, 20 aa, Artificial Sequence
  Description of Artificial Sequence: Synthetic gluten peptide
QPQQQFSQPQQQFPQPQQPQ

SEQ ID NO: 553 - protein, 20 aa, Artificial Sequence
  Description of Artificial Sequence: Synthetic gluten peptide
QQPQQPFPQQPQQQFPQPQQ

SEQ ID NO: 554 - protein, 20 aa, Artificial Sequence
  Description of Artificial Sequence: Synthetic gluten peptide
PQQPQQPFPQQPQQQFPQPQ

SEQ ID NO: 555 - protein, 16 aa, Artificial Sequence
  Description of Artificial Sequence: Synthetic gluten peptide
GFFSQPQQQFPQPQQG

SEQ ID NO: 556 - protein, 20 aa, Artificial Sequence
  Description of Artificial Sequence: Synthetic gluten peptide
TFPHQPQQQFPQPQQPQQPF

SEQ ID NO: 557 - protein, 20 aa, Artificial Sequence
  Description of Artificial Sequence: Synthetic gluten peptide
QTFPHQPQQQFPQPQQPQQQ

SEQ ID NO: 558 - protein, 16 aa, Artificial Sequence
  Description of Artificial Sequence: Synthetic gluten peptide
GFPQQPQQQFPQPQQG

SEQ ID NO: 559 - protein, 20 aa, Artificial Sequence
  Description of Artificial Sequence: Synthetic gluten peptide
SQPQQQFPQPQQPQQSFPQQ

SEQ ID NO: 560 - protein, 20 aa, Artificial Sequence
  Description of Artificial Sequence: Synthetic gluten peptide
QTCPHQPQQQFPQPQQPQQP

SEQ ID NO: 561 - protein, 20 aa, Artificial Sequence
  Description of Artificial Sequence: Synthetic gluten peptide
PVPQLQPKNPSQQQPQEQVP

SEQ ID NO: 562 - protein, 20 aa, Artificial Sequence
  Description of Artificial Sequence: Synthetic gluten peptide
AVRVPVPQLQPKNPSQQQPQ

SEQ ID NO: 563 - protein, 20 aa, Artificial Sequence
  Description of Artificial Sequence: Synthetic gluten peptide
METSCISGLERPWQQQPLPP

SEQ ID NO: 564 - protein, 20 aa, Artificial Sequence
  Description of Artificial Sequence: Synthetic gluten peptide
PWQQQPLPPQQSFSQQPPFS

SEQ ID NO: 565 - protein, 20 aa, Artificial Sequence
  Description of Artificial Sequence: Synthetic gluten peptide
PWQQQPLPPQQSFSQQPPFS

SEQ ID NO: 566 - protein, 20 aa, Artificial Sequence
  Description of Artificial Sequence: Synthetic gluten peptide
ERPWQEQPLPPQHTLFPQQQ

SEQ ID NO: 567 - protein, 20 aa, Artificial Sequence
  Description of Artificial Sequence: Synthetic gluten peptide
ETRCIPGLERPWQQQPLPPQ

SEQ ID NO: 568 - protein, 20 aa, Artificial Sequence
  Description of Artificial Sequence: Synthetic gluten peptide
SHIPGLERPWQQQPLPPQQT

SEQ ID NO: 569 - protein, 20 aa, Artificial Sequence
  Description of Artificial Sequence: Synthetic gluten peptide
MRCIPGLERPWQQQPLPPQQ

SEQ ID NO: 570 - protein, 20 aa, Artificial Sequence
  Description of Artificial Sequence: Synthetic gluten peptide
SCISGLERPWQQQPLPPQQS

SEQ ID NO: 571 - protein, 20 aa, Artificial Sequence
  Description of Artificial Sequence: Synthetic gluten peptide
PWQQQPLPPQQTLFPQQQPF

SEQ ID NO: 572 - protein, 20 aa, Artificial Sequence
  Description of Artificial Sequence: Synthetic gluten peptide
ERPWQQQPLPPQQSFSQQPP

SEQ ID NO: 573 - protein, 20 aa, Artificial Sequence
  Description of Artificial Sequence: Synthetic gluten peptide
SCISGLERPWQQQPLPPQQS

SEQ ID NO: 574 - protein, 20 aa, Artificial Sequence
  Description of Artificial Sequence: Synthetic gluten peptide
RPWQQQPLPPQQTFPQQPPF

SEQ ID NO: 575 - protein, 20 aa, Artificial Sequence
  Description of Artificial Sequence: Synthetic gluten peptide
PWQEQPLPPQHTLFPQQQPF

SEQ ID NO: 576 - protein, 20 aa, Artificial Sequence
  Description of Artificial Sequence: Synthetic gluten peptide
EKPWQQQPLPPQQQPPCSQQ

SEQ ID NO: 577 - protein, 20 aa, Artificial Sequence
  Description of Artificial Sequence: Synthetic gluten peptide
PWQQQPLPPQQSFSQQPPFS

SEQ ID NO: 578 - protein, 20 aa, Artificial Sequence
  Description of Artificial Sequence: Synthetic gluten peptide
ETSCIPGLERPWQEQPLPPQ

SEQ ID NO: 579 - protein, 20 aa, Artificial Sequence
  Description of Artificial Sequence: Synthetic gluten peptide
SQQPPFSQQQQQPLPQQPSF

SEQ ID NO: 580 - protein, 20 aa, Artificial Sequence
  Description of Artificial Sequence: Synthetic gluten peptide
QPLPQQPSFSQQQPPFSQQQ

SEQ ID NO: 581 - protein, 20 aa, Artificial Sequence
  Description of Artificial Sequence: Synthetic gluten peptide
QQQQQPLPQQPSFSQQQPPF

SEQ ID NO: 582 - protein, 20 aa, Artificial Sequence
  Description of Artificial Sequence: Synthetic gluten peptide
PPFSQQQQQPLPQQPSFSQQ

SEQ ID NO: 583 - protein, 20 aa, Artificial Sequence
  Description of Artificial Sequence: Synthetic gluten peptide
QPLPQQPSFSQQQPPFSQQQ

SEQ ID NO: 584 - protein, 20 aa, Artificial Sequence
  Description of Artificial Sequence: Synthetic gluten peptide
SQQPPFSQQQQQPLPQQPSF

SEQ ID NO: 585 - protein, 16 aa, Artificial Sequence
  Description of Artificial Sequence: Synthetic gluten peptide
GQQQQPLPEQPSFSPG

SEQ ID NO: 586 - protein, 20 aa, Artificial Sequence
  Description of Artificial Sequence: Synthetic gluten peptide
QQQQQPLPQQPSFSQQQPPF

SEQ ID NO: 587 - protein, 16 aa, Artificial Sequence
  Description of Artificial Sequence: Synthetic gluten peptide
GQQQQPLPQQPSFSPG

SEQ ID NO: 588 - protein, 20 aa, Artificial Sequence
  Description of Artificial Sequence: Synthetic gluten peptide
QQSRYEAIRAIVYSTILQEQ

SEQ ID NO: 589 - protein, 20 aa, Artificial Sequence
  Description of Artificial Sequence: Synthetic gluten peptide
AIVYSTILQEQQQVQGSIQT

SEQ ID NO: 590 - protein, 20 aa, Artificial Sequence
  Description of Artificial Sequence: Synthetic gluten peptide
QQQPILSQQPPFSQQQQPVL

SEQ ID NO: 591 - protein, 20 aa, Artificial Sequence
  Description of Artificial Sequence: Synthetic gluten peptide
FSQQQPPFSQQQPILSQQPP

SEQ ID NO: 592 - protein, 20 aa, Artificial Sequence
  Description of Artificial Sequence: Synthetic gluten peptide
FSQQQPPFSQQQPILSQQPP

SEQ ID NO: 593 - protein, 20 aa, Artificial Sequence
  Description of Artificial Sequence: Synthetic gluten peptide
QQQPILSQQPPFSQQQQPVL

SEQ ID NO: 594 - protein, 20 aa, Artificial Sequence
  Description of Artificial Sequence: Synthetic gluten peptide
QQQPPFSQQQPILSQQPPFS

SEQ ID NO: 595 - protein, 20 aa, Artificial Sequence
  Description of Artificial Sequence: Synthetic gluten peptide
SQQQPILSQQPPFSQQQQPV

SEQ ID NO: 596 - protein, 20 aa, Artificial Sequence
  Description of Artificial Sequence: Synthetic gluten peptide
QQQPPFSQQQPILSQQPPFS

SEQ ID NO: 597 - protein, 20 aa, Artificial Sequence
  Description of Artificial Sequence: Synthetic gluten peptide
VMQQEQQQGIQILRPLFQLV

SEQ ID NO: 598 - protein, 20 aa, Artificial Sequence
  Description of Artificial Sequence: Synthetic gluten peptide
QEQQQGIQILRPLFQLVQGQ

SEQ ID NO: 599 - protein, 20 aa, Artificial Sequence
  Description of Artificial Sequence: Synthetic gluten peptide
CSIIKAPFSSVVAGIGGQYR

SEQ ID NO: 600 - protein, 18 aa, Artificial Sequence
  Description of Artificial Sequence: Synthetic gluten peptide
CSIIKAPFSSVVAGIGGQ

SEQ ID NO: 601 - protein, 19 aa, Artificial Sequence
  Description of Artificial Sequence: Synthetic gluten peptide
YIPPYCSTTIAPVGIFGTN

SEQ ID NO: 602 - protein, 20 aa, Artificial Sequence
  Description of Artificial Sequence: Synthetic gluten peptide
VYIPPYCSTTIAPVGIFGTN

SEQ ID NO: 603 - protein, 20 aa, Artificial Sequence
  Description of Artificial Sequence: Synthetic gluten peptide
QQCSHVAMSQRLARSQMWQQ

SEQ ID NO: 604 - protein, 20 aa, Artificial Sequence
  Description of Artificial Sequence: Synthetic gluten peptide
KVFLQQQCSHVAMSQRLARP

SEQ ID NO: 605 - protein, 20 aa, Artificial Sequence
  Description of Artificial Sequence: Synthetic gluten peptide
QCSHVAMSQRLARPQMWQQS

SEQ ID NO: 606 - protein, 20 aa, Artificial Sequence
  Description of Artificial Sequence: Synthetic gluten peptide
FLPQLPYPQPQSFPPQQPYP

SEQ ID NO: 607 - protein, 20 aa, Artificial Sequence
  Description of Artificial Sequence: Synthetic gluten peptide
PQPFLPQLPYPQPQSFPPQQ

SEQ ID NO: 608 - protein, 20 aa, Artificial Sequence
  Description of Artificial Sequence: Synthetic gluten peptide
PQPFLPQLPYPQPQSFPPQQ

SEQ ID NO: 609 - protein, 20 aa, Artificial Sequence
  Description of Artificial Sequence: Synthetic gluten peptide
PQPFPPQLPYPQPQSFPPQQ

SEQ ID NO: 610 - protein, 16 aa, Artificial Sequence
  Description of Artificial Sequence: Synthetic gluten peptide
GQPQSFPPEQPYPQQG

SEQ ID NO: 611 - protein, 20 aa, Artificial Sequence
  Description of Artificial Sequence: Synthetic gluten peptide
LPQLPYPQPQSFPPQQPYPQ

SEQ ID NO: 612 - protein, 16 aa, Artificial Sequence
  Description of Artificial Sequence: Synthetic gluten peptide
GQPQSFPPQQPYPQQG

SEQ ID NO: 613 - protein, 20 aa, Artificial Sequence
  Description of Artificial Sequence: Synthetic gluten peptide
RYDAICAITYSIILQEQQQG

SEQ ID NO: 614 - protein, 20 aa, Artificial Sequence
  Description of Artificial Sequence: Synthetic gluten peptide
AIRAIIYSIILQEQQQGFVQ

SEQ ID NO: 615 - protein, 20 aa, Artificial Sequence
  Description of Artificial Sequence: Synthetic gluten peptide
IRAIVYSIILQEQQQGFVQP

SEQ ID NO: 616 - protein, 20 aa, Artificial Sequence
  Description of Artificial Sequence: Synthetic gluten peptide
IIYSIILQEQQQGQGSVESQ

SEQ ID NO: 617 - protein, 20 aa, Artificial Sequence
  Description of Artificial Sequence: Synthetic gluten peptide
AIRAIIYSIILQEQQQVQGS

SEQ ID NO: 618 - protein, 20 aa, Artificial Sequence
  Description of Artificial Sequence: Synthetic gluten peptide
AIIYSIILQEQQQGFVQPQQ

SEQ ID NO: 619 - protein, 20 aa, Artificial Sequence
  Description of Artificial Sequence: Synthetic gluten peptide
RYEAIRAIVYSIILQEQQQV

SEQ ID NO: 620 - protein, 20 aa, Artificial Sequence
  Description of Artificial Sequence: Synthetic gluten peptide
IRAITYSIILQEQQQGFVQA

SEQ ID NO: 621 - protein, 20 aa, Artificial Sequence
  Description of Artificial Sequence: Synthetic gluten peptide
VYSIILQQQQQQQQQQQGQS

SEQ ID NO: 622 - protein, 20 aa, Artificial Sequence
  Description of Artificial Sequence: Synthetic gluten peptide
AIIYSIILQEQQQVQGSIQS

SEQ ID NO: 623 - protein, 20 aa, Artificial Sequence
  Description of Artificial Sequence: Synthetic gluten peptide
SIRAIVYSIILQQQQQQQQQ

SEQ ID NO: 624 - protein, 20 aa, Artificial Sequence
  Description of Artificial Sequence: Synthetic gluten peptide
AIIYSIILQEQQQVQGSIQS

SEQ ID NO: 625 - protein, 20 aa, Artificial Sequence
  Description of Artificial Sequence: Synthetic gluten peptide
AIIFSIILQEQQQGFVQPQQ

SEQ ID NO: 626 - protein, 20 aa, Artificial Sequence
  Description of Artificial Sequence: Synthetic gluten peptide
SIILQEQQQGQGSVESQEQQ

SEQ ID NO: 627 - protein, 20 aa, Artificial Sequence
  Description of Artificial Sequence: Synthetic gluten peptide
RHESIRAIIYSIILQQQQQQ

SEQ ID NO: 628 - protein, 20 aa, Artificial Sequence
  Description of Artificial Sequence: Synthetic gluten peptide
YSIILQEQQQGFVQPQQQQP

SEQ ID NO: 629 - protein, 20 aa, Artificial Sequence
  Description of Artificial Sequence: Synthetic gluten peptide
AIRAIIYSIILQEQQQVQGS

SEQ ID NO: 630 - protein, 20 aa, Artificial Sequence
  Description of Artificial Sequence: Synthetic gluten peptide
YEAIRAIIYSIILQEQQQGF

SEQ ID NO: 631 - protein, 20 aa, Artificial Sequence
  Description of Artificial Sequence: Synthetic gluten peptide
HQPQQQFPQTQQPQQPFPQP

SEQ ID NO: 632 - protein, 20 aa, Artificial Sequence
  Description of Artificial Sequence: Synthetic gluten peptide
PQTQQPQQPFPQPQQTFPQQ

SEQ ID NO: 633 - protein, 20 aa, Artificial Sequence
  Description of Artificial Sequence: Synthetic gluten peptide
QQPFPQTQQPQQPFPQQPQQ

SEQ ID NO: 634 - protein, 20 aa, Artificial Sequence
  Description of Artificial Sequence: Synthetic gluten peptide
QTQQPQQPFPQQPQQPFPQT

SEQ ID NO: 635 - protein, 20 aa, Artificial Sequence
  Description of Artificial Sequence: Synthetic gluten peptide
QPQQPFPQSQQPQQPFPQPQ

SEQ ID NO: 636 - protein, 16 aa, Artificial Sequence
  Description of Artificial Sequence: Synthetic gluten peptide
GFPQTQQPEQPFPQQG

SEQ ID NO: 637 - protein, 16 aa, Artificial Sequence
  Description of Artificial Sequence: Synthetic gluten peptide
GFPQSQQPEQPFPQQG

SEQ ID NO: 638 - protein, 20 aa, Artificial Sequence
  Description of Artificial Sequence: Synthetic gluten peptide
PQQPQQPFPQTQQPQQPFPQ

SEQ ID NO: 639 - protein, 20 aa, Artificial Sequence
  Description of Artificial Sequence: Synthetic gluten peptide
QQPFPQTQQPQQPFPQLQQP

SEQ ID NO: 640 - protein, 20 aa, Artificial Sequence
  Description of Artificial Sequence: Synthetic gluten peptide
QPQQPFPQSQQPQQPFPQPQ

SEQ ID NO: 641 - protein, 20 aa, Artificial Sequence
  Description of Artificial Sequence: Synthetic gluten peptide
QPQQPFPQTQQPQQPFPQQP

SEQ ID NO: 642 - protein, 20 aa, Artificial Sequence
  Description of Artificial Sequence: Synthetic gluten peptide
PQTQQPQQPFPQSQQPQQPF

SEQ ID NO: 643 - protein, 20 aa, Artificial Sequence
  Description of Artificial Sequence: Synthetic gluten peptide
QQFPQTQQPQQPFPQPQQTF

SEQ ID NO: 644 - protein, 16 aa, Artificial Sequence
  Description of Artificial Sequence: Synthetic gluten peptide
GQQPFPQSQQPQQPFG

SEQ ID NO: 645 - protein, 20 aa, Artificial Sequence
  Description of Artificial Sequence: Synthetic gluten peptide
QQPFPQTQQPQQPFPQQPQQ

SEQ ID NO: 646 - protein, 16 aa, Artificial Sequence
  Description of Artificial Sequence: Synthetic gluten peptide
GFPQSQQPQQPFPQQG

SEQ ID NO: 647 - protein, 20 aa, Artificial Sequence
  Description of Artificial Sequence: Synthetic gluten peptide
QQPFPQTQQPQQPFPQSKQP

SEQ ID NO: 648 - protein, 20 aa, Artificial Sequence
  Description of Artificial Sequence: Synthetic gluten peptide
QQPFPQTQQPQQPFPQSQQP

SEQ ID NO: 649 - protein, 16 aa, Artificial Sequence
  Description of Artificial Sequence: Synthetic gluten peptide
GFPQTQQPQQPFPQQG

SEQ ID NO: 650 - protein, 16 aa, Artificial Sequence
  Description of Artificial Sequence: Synthetic gluten peptide
GQQPFPQSEQPQQPFG

SEQ ID NO: 651 - protein, 16 aa, Artificial Sequence
  Description of Artificial Sequence: Synthetic gluten peptide
GQQPFPQTQQPQQPFG

SEQ ID NO: 652 - protein, 16 aa, Artificial Sequence
  Description of Artificial Sequence: Synthetic gluten peptide
GQQPFPQTEQPQQPFG

SEQ ID NO: 653 - protein, 20 aa, Artificial Sequence
  Description of Artificial Sequence: Synthetic gluten peptide
PFPQTQQPQQPFPQLQQPQQ

SEQ ID NO: 654 - protein, 20 aa, Artificial Sequence
  Description of Artificial Sequence: Synthetic gluten peptide
QPFPQLQQPQQPLPQPQQPQ

SEQ ID NO: 655 - protein, 16 aa, Artificial Sequence
  Description of Artificial Sequence: Synthetic gluten peptide
GFPQLQQPEQPLPQQG

SEQ ID NO: 656 - protein, 20 aa, Artificial Sequence
  Description of Artificial Sequence: Synthetic gluten peptide
QPQQPFPQLQQPQQPLPQPQ

SEQ ID NO: 657 - protein, 16 aa, Artificial Sequence
  Description of Artificial Sequence: Synthetic gluten peptide
GFPQLQQPQQPLPQQG

SEQ ID NO: 658 - protein, 16 aa, Artificial Sequence
  Description of Artificial Sequence: Synthetic gluten peptide
GQPIPQQPEQPFPLQG

SEQ ID NO: 659 - protein, 20 aa, Artificial Sequence
  Description of Artificial Sequence: Synthetic gluten peptide
FPELQQPIPQQPQQPFPLQP

SEQ ID NO: 660 - protein, 20 aa, Artificial Sequence
  Description of Artificial Sequence: Synthetic gluten peptide
FPELQQPIPQQPQQPFPLQP

SEQ ID NO: 661 - protein, 16 aa, Artificial Sequence
  Description of Artificial Sequence: Synthetic gluten peptide
GQPIPQQPQQPFPLQG

SEQ ID NO: 662 - protein, 16 aa, Artificial Sequence
  Description of Artificial Sequence: Synthetic gluten peptide
GQLQQPIPQQPQQPFG

SEQ ID NO: 663 - protein, 16 aa, Artificial Sequence
  Description of Artificial Sequence: Synthetic gluten peptide
GQLQQPIPEQPQQPFG

SEQ ID NO: 664 - protein, 20 aa, Artificial Sequence
  Description of Artificial Sequence: Synthetic gluten peptide
QQPFPQQPQQPFPQPQQPIP

SEQ ID NO: 665 - protein, 20 aa, Artificial Sequence
  Description of Artificial Sequence: Synthetic gluten peptide
FPQQPQQPFPQPQLPFPQQS

SEQ ID NO: 666 - protein, 20 aa, Artificial Sequence
  Description of Artificial Sequence: Synthetic gluten peptide
QQFLQPQQPFPQQPQQPYPQ

SEQ ID NO: 667 - protein, 20 aa, Artificial Sequence
  Description of Artificial Sequence: Synthetic gluten peptide
PLQPQQPFPQQPQQPFPQPQ

SEQ ID NO: 668 - protein, 20 aa, Artificial Sequence
  Description of Artificial Sequence: Synthetic gluten peptide
QLPFPQQPQQPFPQPQQPQQ

SEQ ID NO: 669 - protein, 20 aa, Artificial Sequence
  Description of Artificial Sequence: Synthetic gluten peptide
TQQPQQPFPQQPQQPFPQTQ

SEQ ID NO: 670 - protein, 20 aa, Artificial Sequence
  Description of Artificial Sequence: Synthetic gluten peptide
QTQQPQQPFPQQPQQPFPQT

SEQ ID NO: 671 - protein, 20 aa, Artificial Sequence
  Description of Artificial Sequence: Synthetic gluten peptide
PQPQQPQLPFPQQPQQPFPQ

SEQ ID NO: 672 - protein, 20 aa, Artificial Sequence
  Description of Artificial Sequence: Synthetic gluten peptide
QQPFPQQPQQPFPQTQQPQQ

SEQ ID NO: 673 - protein, 20 aa, Artificial Sequence
  Description of Artificial Sequence: Synthetic gluten peptide
QQPYPQQPQQPFPQTQQPQQ

SEQ ID NO: 674 - protein, 16 aa, Artificial Sequence
  Description of Artificial Sequence: Synthetic gluten peptide
GQPFPQQPEQPFPQQG

SEQ ID NO: 675 - protein, 20 aa, Artificial Sequence
  Description of Artificial Sequence: Synthetic gluten peptide
FPLQPQQPFPQQPQQPFPQP

SEQ ID NO: 676 - protein, 20 aa, Artificial Sequence
  Description of Artificial Sequence: Synthetic gluten peptide
PQQPFLQPQQPFPQQPQQPF

SEQ ID NO: 677 - protein, 20 aa, Artificial Sequence
  Description of Artificial Sequence: Synthetic gluten peptide
PLQPQQPFPQQPQQPFPQQP

SEQ ID NO: 678 - protein, 16 aa, Artificial Sequence
  Description of Artificial Sequence: Synthetic gluten peptide
GQPQQPFPEQPQQPFG

SEQ ID NO: 679 - protein, 16 aa, Artificial Sequence
  Description of Artificial Sequence: Synthetic gluten peptide
GQPYPQQPEQPFPQQG

SEQ ID NO: 680 - protein, 16 aa, Artificial Sequence
  Description of Artificial Sequence: Synthetic gluten peptide
GQPFPQQPQQPFPQQG

SEQ ID NO: 681 - protein, 20 aa, Artificial Sequence
  Description of Artificial Sequence: Synthetic gluten peptide
YPQQPFPQQPQQPFPQQPPF

SEQ ID NO: 682 - protein, 20 aa, Artificial Sequence
  Description of Artificial Sequence: Synthetic gluten peptide
QQTFPQQPQLPFPQQPQQPF

SEQ ID NO: 683 - protein, 20 aa, Artificial Sequence
  Description of Artificial Sequence: Synthetic gluten peptide
PQQQFLQPQQPFPQQPQQPY

SEQ ID NO: 684 - protein, 20 aa, Artificial Sequence
  Description of Artificial Sequence: Synthetic gluten peptide
PLQPQQPFPQQPQQPFPQPQ

SEQ ID NO: 685 - protein, 16 aa, Artificial Sequence
  Description of Artificial Sequence: Synthetic gluten peptide
GQPQQPFPQQPQQPFG

SEQ ID NO: 686 - protein, 20 aa, Artificial Sequence
  Description of Artificial Sequence: Synthetic gluten peptide
RQPFPQQPQQPYPQQPQQPF

SEQ ID NO: 687 - protein, 16 aa, Artificial Sequence
  Description of Artificial Sequence: Synthetic gluten peptide
GQPYPQQPQQPFPQQG

SEQ ID NO: 688 - protein, 20 aa, Artificial Sequence
  Description of Artificial Sequence: Synthetic gluten peptide
QQPFPQQPQQPYPQQPQQPF

SEQ ID NO: 689 - protein, 20 aa, Artificial Sequence
  Description of Artificial Sequence: Synthetic gluten peptide
QPQQPFPQQPQQPFPQTQQP

SEQ ID NO: 690 - protein, 20 aa, Artificial Sequence
  Description of Artificial Sequence: Synthetic gluten peptide
FPQQPQQPYPQQPQQPFPQT

SEQ ID NO: 691 - protein, 20 aa, Artificial Sequence
  Description of Artificial Sequence: Synthetic gluten peptide
FPQQPRQPYPQQPQQPFPQT

SEQ ID NO: 692 - protein, 15 aa, Artificial Sequence
  Description of Artificial Sequence: Synthetic gluten peptide
PFPEQPEQPYPQQPQ

SEQ ID NO: 693 - protein, 20 aa, Artificial Sequence
  Description of Artificial Sequence: Synthetic gluten peptide
PFPQQPQQPFPQQPQQSFPQ

SEQ ID NO: 694 - protein, 16 aa, Artificial Sequence
  Description of Artificial Sequence: Synthetic gluten peptide
GQPQLPFPEQPQQPFG

SEQ ID NO: 695 - protein, 16 aa, Artificial Sequence
  Description of Artificial Sequence: Synthetic gluten peptide
GQPQLPFPQQPQQPFG

SEQ ID NO: 696 - protein, 20 aa, Artificial Sequence
  Description of Artificial Sequence: Synthetic gluten peptide
PQQPQQSFPQQPQQPYPQQQ

SEQ ID NO: 697 - protein, 20 aa, Artificial Sequence
  Description of Artificial Sequence: Synthetic gluten peptide
QQPQQSFPQQPQQPYPQQQP

SEQ ID NO: 698 - protein, 20 aa, Artificial Sequence
  Description of Artificial Sequence: Synthetic gluten peptide
LQPQQPFPQQPQQPYPQQPQ

SEQ ID NO: 699 - protein, 20 aa, Artificial Sequence
  Description of Artificial Sequence: Synthetic gluten peptide
PQQQFLQPRQPFPQQPQQPY

SEQ ID NO: 700 - protein, 20 aa, Artificial Sequence
  Description of Artificial Sequence: Synthetic gluten peptide
PRQPFPQQPQQPYPQQPQQP

SEQ ID NO: 701 - protein, 16 aa, Artificial Sequence
  Description of Artificial Sequence: Synthetic gluten peptide
GQPTPIQPEQPFPQQG

SEQ ID NO: 702 - protein, 20 aa, Artificial Sequence
  Description of Artificial Sequence: Synthetic gluten peptide
FTQPQQPTPIQPQQPFPQQP

SEQ ID NO: 703 - protein, 20 aa, Artificial Sequence
  Description of Artificial Sequence: Synthetic gluten peptide
PFTQPQQPTPIQPQQPFPQQ

SEQ ID NO: 704 - protein, 20 aa, Artificial Sequence
  Description of Artificial Sequence: Synthetic gluten peptide
TPIQPQQPFPQQPQQPQQPF

SEQ ID NO: 705 - protein, 16 aa, Artificial Sequence
  Description of Artificial Sequence: Synthetic gluten peptide
GQPTPIQPQQPFPQQG

SEQ ID NO: 706 - protein, 16 aa, Artificial Sequence
  Description of Artificial Sequence: Synthetic gluten peptide
GQPFSQQPEQIFPQQG

SEQ ID NO: 707 - protein, 20 aa, Artificial Sequence
  Description of Artificial Sequence: Synthetic gluten peptide
QQPFSQQPQQIFPQPQQTFP

SEQ ID NO: 708 - protein, 20 aa, Artificial Sequence
  Description of Artificial Sequence: Synthetic gluten peptide
QQQQPFPQPQQPFSQQPQQI

SEQ ID NO: 709 - protein, 20 aa, Artificial Sequence
  Description of Artificial Sequence: Synthetic gluten peptide
HQPFSQQPQQIFPQPQQTFP

SEQ ID NO: 710 - protein, 16 aa, Artificial Sequence
  Description of Artificial Sequence: Synthetic gluten peptide
GQPFSQQPQQIFPQQG

SEQ ID NO: 711 - protein, 20 aa, Artificial Sequence
  Description of Artificial Sequence: Synthetic gluten peptide
PFLQPHQPFSQQPQQIFPQP

SEQ ID NO: 712 - protein, 16 aa, Artificial Sequence
  Description of Artificial Sequence: Synthetic gluten peptide
GQPQQPFSEQPQQIFG

SEQ ID NO: 713 - protein, 20 aa, Artificial Sequence
  Description of Artificial Sequence: Synthetic gluten peptide
QQQPFLQPHQPFSQQPQQIF

SEQ ID NO: 714 - protein, 20 aa, Artificial Sequence
  Description of Artificial Sequence: Synthetic gluten peptide
QPQQPFSQQPQQIFPQPQQT

SEQ ID NO: 715 - protein, 16 aa, Artificial Sequence
  Description of Artificial Sequence: Synthetic gluten peptide
GQPQQPFSQQPQQIFG

SEQ ID NO: 716 - protein, 16 aa, Artificial Sequence
  Description of Artificial Sequence: Synthetic gluten peptide
GQQIFPQPEQTFPHQG

SEQ ID NO: 717 - protein, 16 aa, Artificial Sequence
  Description of Artificial Sequence: Synthetic gluten peptide
GQQIFPQPQQTFPHQG

SEQ ID NO: 718 - protein, 20 aa, Artificial Sequence
  Description of Artificial Sequence: Synthetic gluten peptide
PQQPQQPQQPFPQPQQPFPW

SEQ ID NO: 719 - protein, 20 aa, Artificial Sequence
  Description of Artificial Sequence: Synthetic gluten peptide
PQQPQQPQQPFPQPQQPFPW

SEQ ID NO: 720 - protein, 20 aa, Artificial Sequence
  Description of Artificial Sequence: Synthetic gluten peptide
PQQPFPQPQQPQQPFPQPQQ

SEQ ID NO: 721 - protein, 20 aa, Artificial Sequence
  Description of Artificial Sequence: Synthetic gluten peptide
PQQQFPQPQQPQQPFPQQPQ

SEQ ID NO: 722 - protein, 20 aa, Artificial Sequence
  Description of Artificial Sequence: Synthetic gluten peptide
QPQQPQQPFPQPQQPQLPFP

SEQ ID NO: 723 - protein, 20 aa, Artificial Sequence
  Description of Artificial Sequence: Synthetic gluten peptide
PQQPFPQQPQQPQQPFPQPQ

SEQ ID NO: 724 - protein, 20 aa, Artificial Sequence
  Description of Artificial Sequence: Synthetic gluten peptide
QQQQPFPQPQQPQQPFPQPQ

SEQ ID NO: 725 - protein, 20 aa, Artificial Sequence
  Description of Artificial Sequence: Synthetic gluten peptide
TPIQPQQPFPQQPQQPQQPF

SEQ ID NO: 726 - protein, 20 aa, Artificial Sequence
  Description of Artificial Sequence: Synthetic gluten peptide
PIQPQQPFPQQPQQPQQPFP

SEQ ID NO: 727 - protein, 20 aa, Artificial Sequence
  Description of Artificial Sequence: Synthetic gluten peptide
QQFPQPQQPQQPFPQQPQQQ

SEQ ID NO: 728 - protein, 16 aa, Artificial Sequence
  Description of Artificial Sequence: Synthetic gluten peptide
GQQPFPQPEQPQQPFG

SEQ ID NO: 729 - protein, 20 aa, Artificial Sequence
  Description of Artificial Sequence: Synthetic gluten peptide
QQPQQQFPQPQQPQQPFPQP

SEQ ID NO: 730 - protein, 20 aa, Artificial Sequence
  Description of Artificial Sequence: Synthetic gluten peptide
LQQPQQPLPQPQQPQQPFPQ

SEQ ID NO: 731 - protein, 16 aa, Artificial Sequence
  Description of Artificial Sequence: Synthetic gluten peptide
GFPQPQQPEQPFPQQG

SEQ ID NO: 732 - protein, 16 aa, Artificial Sequence
  Description of Artificial Sequence: Synthetic gluten peptide
GFPQPQQPQQPFPQQG

SEQ ID NO: 733 - protein, 20 aa, Artificial Sequence
  Description of Artificial Sequence: Synthetic gluten peptide
QQPFPQPQQPQQPFPQLQQP

SEQ ID NO: 734 - protein, 20 aa, Artificial Sequence
  Description of Artificial Sequence: Synthetic gluten peptide
PQQQFPQPQQPQQPFPQQPQ

SEQ ID NO: 735 - protein, 20 aa, Artificial Sequence
  Description of Artificial Sequence: Synthetic gluten peptide
QPQQPQQPFPQQQQPLIQPY

SEQ ID NO: 736 - protein, 20 aa, Artificial Sequence
  Description of Artificial Sequence: Synthetic gluten peptide
PQQPFPQPQQPQQPFPQLQQ

SEQ ID NO: 737 - protein, 16 aa, Artificial Sequence
  Description of Artificial Sequence: Synthetic gluten peptide
GQQPFPQPQQPQQPFG

SEQ ID NO: 738 - protein, 16 aa, Artificial Sequence
  Description of Artificial Sequence: Synthetic gluten peptide
GQQPLPQPEQPQQPFG

SEQ ID NO: 739 - protein, 20 aa, Artificial Sequence
  Description of Artificial Sequence: Synthetic gluten peptide
PQPQQPQQPFPQQQQPLIQP

SEQ ID NO: 740 - protein, 20 aa, Artificial Sequence
  Description of Artificial Sequence: Synthetic gluten peptide
QQPFPQPQQPQQPFPQSQQP

SEQ ID NO: 741 - protein, 20 aa, Artificial Sequence
  Description of Artificial Sequence: Synthetic gluten peptide
TFPHQPQQQVPQPQQPQQPF

SEQ ID NO: 742 - protein, 16 aa, Artificial Sequence
  Description of Artificial Sequence: Synthetic gluten peptide
GQQQFPQPQQPQQPFG

SEQ ID NO: 743 - protein, 16 aa, Artificial Sequence
  Description of Artificial Sequence: Synthetic gluten peptide
GQQPLPQPQQPQQPFG

SEQ ID NO: 744 - protein, 20 aa, Artificial Sequence
  Description of Artificial Sequence: Synthetic gluten peptide
TFPHQPQQQFPQPQQPQQPF

SEQ ID NO: 745 - protein, 20 aa, Artificial Sequence
  Description of Artificial Sequence: Synthetic gluten peptide
QQPLPQPQQPQQPFPQSQQP

SEQ ID NO: 746 - protein, 16 aa, Artificial Sequence
  Description of Artificial Sequence: Synthetic gluten peptide
GQQQFPQPEQPQQPFG

SEQ ID NO: 747 - protein, 20 aa, Artificial Sequence
  Description of Artificial Sequence: Synthetic gluten peptide
QQVPQPQQPQQPFLQPQQPF

SEQ ID NO: 748 - protein, 20 aa, Artificial Sequence
  Description of Artificial Sequence: Synthetic gluten peptide
QQPLPQPQQPQQPFPQSQQP

SEQ ID NO: 749 - protein, 20 aa, Artificial Sequence
  Description of Artificial Sequence: Synthetic gluten peptide
QQVPQPQQPQQPFLQPQQPF

SEQ ID NO: 750 - protein, 20 aa, Artificial Sequence
  Description of Artificial Sequence: Synthetic gluten peptide
PQQAQLPFPQQPQQPLPQPQ

SEQ ID NO: 751 - protein, 20 aa, Artificial Sequence
  Description of Artificial Sequence: Synthetic gluten peptide
QAQLPFPQQPQQPLPQPQQP

SEQ ID NO: 752 - protein, 20 aa, Artificial Sequence
  Description of Artificial Sequence: Synthetic gluten peptide
QQPFPQQPQQPSSQQPPFPQ

SEQ ID NO: 753 - protein, 20 aa, Artificial Sequence
  Description of Artificial Sequence: Synthetic gluten peptide
QQQQPSSQQPPFPQQHQQFP

SEQ ID NO: 754 - protein, 20 aa, Artificial Sequence
  Description of Artificial Sequence: Synthetic gluten peptide
PPFSQQQQPSSQQPPFPQQH

SEQ ID NO: 755 - protein, 20 aa, Artificial Sequence
  Description of Artificial Sequence: Synthetic gluten peptide
PQQPFPQPQQTFPQQPQLPF

SEQ ID NO: 756 - protein, 20 aa, Artificial Sequence
  Description of Artificial Sequence: Synthetic gluten peptide
FPQPQQTFPQQPQLPFPQQP

SEQ ID NO: 757 - protein, 20 aa, Artificial Sequence
  Description of Artificial Sequence: Synthetic gluten peptide
QQTFPQQPQLPFPQQPQQPF

SEQ ID NO: 758 - protein, 20 aa, Artificial Sequence
  Description of Artificial Sequence: Synthetic gluten peptide
PQQPFPQPQQTFPQQPQLPF

SEQ ID NO: 759 - protein, 20 aa, Artificial Sequence
  Description of Artificial Sequence: Synthetic gluten peptide
QPFPQPQQPFPWQPQQPFPQ

SEQ ID NO: 760 - protein, 20 aa, Artificial Sequence
  Description of Artificial Sequence: Synthetic gluten peptide
QPFPQPQQPFPWQPQQPFPQ

SEQ ID NO: 761 - protein, 20 aa, Artificial Sequence
  Description of Artificial Sequence: Synthetic gluten peptide
QPFPQPQQPFPWQPQQPFPQ

SEQ ID NO: 762 - protein, 16 aa, Artificial Sequence
  Description of Artificial Sequence: Synthetic gluten peptide
GQPFPWQPQQPFPQQG

SEQ ID NO: 763 - protein, 20 aa, Artificial Sequence
  Description of Artificial Sequence: Synthetic gluten peptide
PFPWQPQQPFPQTQQSFPLQ

SEQ ID NO: 764 - protein, 16 aa, Artificial Sequence
  Description of Artificial Sequence: Synthetic gluten peptide
GQPFPWQPEQPFPQQG

SEQ ID NO: 765 - protein, 16 aa, Artificial Sequence
  Description of Artificial Sequence: Synthetic gluten peptide
GQQIFPQPEQTFPHQG

SEQ ID NO: 766 - protein, 16 aa, Artificial Sequence
  Description of Artificial Sequence: Synthetic gluten peptide
GQQAFPQPEQTFPHQG

SEQ ID NO: 767 - protein, 16 aa, Artificial Sequence
  Description of Artificial Sequence: Synthetic gluten peptide
GQQIFPQPQQTFPHQG

SEQ ID NO: 768 - protein, 16 aa, Artificial Sequence
  Description of Artificial Sequence: Synthetic gluten peptide
GQQTFPQPEQTFPHQG

SEQ ID NO: 769 - protein, 16 aa, Artificial Sequence
  Description of Artificial Sequence: Synthetic gluten peptide
GQQAFPQPQQTFPHQG

SEQ ID NO: 770 - protein, 16 aa, Artificial Sequence
  Description of Artificial Sequence: Synthetic gluten peptide
GQQTFPQPQQTFPHQG

SEQ ID NO: 771 - protein, 20 aa, Artificial Sequence
  Description of Artificial Sequence: Synthetic gluten peptide
QQIFPQPQQTFPHQPQQAFP

SEQ ID NO: 772 - protein, 16 aa, Artificial Sequence
  Description of Artificial Sequence: Synthetic gluten peptide
GQTFPHQPEQAFPQPG

SEQ ID NO: 773 - protein, 20 aa, Artificial Sequence
  Description of Artificial Sequence: Synthetic gluten peptide
QTFPHQPQQAFPQPQQTFPH

SEQ ID NO: 774 - protein, 16 aa, Artificial Sequence
  Description of Artificial Sequence: Synthetic gluten peptide
GQTFPHQPQQAFPQPG

SEQ ID NO: 775 - protein, 20 aa, Artificial Sequence
  Description of Artificial Sequence: Synthetic gluten peptide
PQQTFPHQPQQAFPQPQQTF

SEQ ID NO: 776 - protein, 20 aa, Artificial Sequence
  Description of Artificial Sequence: Synthetic gluten peptide
PQQQPPFSQQQPSFSQQQPP

SEQ ID NO: 777 - protein, 16 aa, Artificial Sequence
  Description of Artificial Sequence: Synthetic gluten peptide
GQQAFPQPEQTFPHQG

SEQ ID NO: 778 - protein, 20 aa, Artificial Sequence
  Description of Artificial Sequence: Synthetic gluten peptide
QAFPQPQQTFPHQPQQQFPQ

SEQ ID NO: 779 - protein, 20 aa, Artificial Sequence
  Description of Artificial Sequence: Synthetic gluten peptide
QAFPQPQQTFPHQPQQQFPQ

SEQ ID NO: 780 - protein, 16 aa, Artificial Sequence
  Description of Artificial Sequence: Synthetic gluten peptide
GQQAFPQPQQTFPHQG

SEQ ID NO: 781 - protein, 20 aa, Artificial Sequence
  Description of Artificial Sequence: Synthetic gluten peptide
QTFPHQPQQAFPQPQQTFPH

SEQ ID NO: 782 - protein, 20 aa, Artificial Sequence
  Description of Artificial Sequence: Synthetic gluten peptide
QQAFPQPQQTFPHQPQQQFP

SEQ ID NO: 783 - protein, 20 aa, Artificial Sequence
  Description of Artificial Sequence: Synthetic gluten peptide
PQQTFPHQPQQAFPQPQQTF

SEQ ID NO: 784 - protein, 20 aa, Artificial Sequence
  Description of Artificial Sequence: Synthetic gluten peptide
QQFPEQSQQPFTQPQQPTPI

SEQ ID NO: 785 - protein, 20 aa, Artificial Sequence
  Description of Artificial Sequence: Synthetic gluten peptide
FPEQSQQPFTQPQQPTPIQP

SEQ ID NO: 786 - protein, 20 aa, Artificial Sequence
  Description of Artificial Sequence: Synthetic gluten peptide
LQPFPQPQPFLPQLPYPQPQ

SEQ ID NO: 787 - protein, 20 aa, Artificial Sequence
  Description of Artificial Sequence: Synthetic gluten peptide
LQLQPFPQPQPFPPQLPYPQ

SEQ ID NO: 788 - protein, 20 aa, Artificial Sequence
  Description of Artificial Sequence: Synthetic gluten peptide
LQLQPFPQPQPFLPQLPYPQ

SEQ ID NO: 789 - protein, 20 aa, Artificial Sequence
  Description of Artificial Sequence: Synthetic gluten peptide
LQLQPFPQPQPFPPQLPYPQ

SEQ ID NO: 790 - protein, 20 aa, Artificial Sequence
  Description of Artificial Sequence: Synthetic gluten peptide
MQLQPFPQPQPFPPQLPYPQ

SEQ ID NO: 791 - protein, 20 aa, Artificial Sequence
  Description of Artificial Sequence: Synthetic gluten peptide
PFPSQQPYMQLQPFPQPQPF

SEQ ID NO: 792 - protein, 20 aa, Artificial Sequence
  Description of Artificial Sequence: Synthetic gluten peptide
FPSQQPYLQLQPFPQPQPFL

SEQ ID NO: 793 - protein, 20 aa, Artificial Sequence
  Description of Artificial Sequence: Synthetic gluten peptide
PFPSQQPYLQLQPFPQPQPF

SEQ ID NO: 794 - protein, 20 aa, Artificial Sequence
  Description of Artificial Sequence: Synthetic gluten peptide
SQQPYLQLQPFPQPQPFPPQ

SEQ ID NO: 795 - protein, 20 aa, Artificial Sequence
  Description of Artificial Sequence: Synthetic gluten peptide
PFPSQQPYMQLQPFPQPQPF

SEQ ID NO: 796 - protein, 20 aa, Artificial Sequence
  Description of Artificial Sequence: Synthetic gluten peptide
QQPYLQLQPFPRPQLPYPQP

SEQ ID NO: 797 - protein, 16 aa, Artificial Sequence
  Description of Artificial Sequence: Synthetic gluten peptide
GLQPFPRPELPYPQPG

SEQ ID NO: 798 - protein, 20 aa, Artificial Sequence
  Description of Artificial Sequence: Synthetic gluten peptide
LQLQPFPRPQLPYPQPQPFR

SEQ ID NO: 799 - protein, 16 aa, Artificial Sequence
  Description of Artificial Sequence: Synthetic gluten peptide
GLQPFPRPQLPYPQPG

SEQ ID NO: 800 - protein, 16 aa, Artificial Sequence
  Description of Artificial Sequence: Synthetic gluten peptide
GQQIFPQPEQTFPHQG

SEQ ID NO: 801 - protein, 16 aa, Artificial Sequence
  Description of Artificial Sequence: Synthetic gluten peptide
GQQIFPQPQQTFPHQG

SEQ ID NO: 802 - protein, 20 aa, Artificial Sequence
  Description of Artificial Sequence: Synthetic gluten peptide
QQIFPQPQQTFPHQPQQAFP

SEQ ID NO: 803 - protein, 20 aa, Artificial Sequence
  Description of Artificial Sequence: Synthetic gluten peptide
PQQIFPQPQQTFPHQPQQQF

SEQ ID NO: 804 - protein, 20 aa, Artificial Sequence
  Description of Artificial Sequence: Synthetic gluten peptide
QQIFPQPQQTFPHQPQQQFP

SEQ ID NO: 805 - protein, 20 aa, Artificial Sequence
  Description of Artificial Sequence: Synthetic gluten peptide
QQPFSQQPQQIFPQPQQTFP

SEQ ID NO: 806 - protein, 20 aa, Artificial Sequence
  Description of Artificial Sequence: Synthetic gluten peptide
HQPFSQQPQQIFPQPQQTFP

SEQ ID NO: 807 - protein, 20 aa, Artificial Sequence
  Description of Artificial Sequence: Synthetic gluten peptide
QPQQPFSQQPQQIFPQPQQT

SEQ ID NO: 808 - protein, 20 aa, Artificial Sequence
  Description of Artificial Sequence: Synthetic gluten peptide
PQQQFIQPQQPQQTYPQRPQ

SEQ ID NO: 809 - protein, 20 aa, Artificial Sequence
  Description of Artificial Sequence: Synthetic gluten peptide
QPQQQFIQPQQPQQTYPQRP

SEQ ID NO: 810 - protein, 20 aa, Artificial Sequence
  Description of Artificial Sequence: Synthetic gluten peptide
QPFPQQPQQTYPQRPQQPFP

SEQ ID NO: 811 - protein, 20 aa, Artificial Sequence
  Description of Artificial Sequence: Synthetic gluten peptide
PQQPFPQQPQQTYPQRPQQP

SEQ ID NO: 812 - protein, 20 aa, Artificial Sequence
  Description of Artificial Sequence: Synthetic gluten peptide
PQQQFIQPQQPQQTYPQRPQ

SEQ ID NO: 813 - protein, 20 aa, Artificial Sequence
  Description of Artificial Sequence: Synthetic gluten peptide
QQPFPQQPQQTYPQRPQQPF

SEQ ID NO: 814 - protein, 20 aa, Artificial Sequence
  Description of Artificial Sequence: Synthetic gluten peptide
QQPFPQQPQQTYPQRPQQPF

SEQ ID NO: 815 - protein, 20 aa, Artificial Sequence
  Description of Artificial Sequence: Synthetic gluten peptide
QQTYPQRPQQPFPQTQQPQQ

SEQ ID NO: 816 - protein, 20 aa, Artificial Sequence
  Description of Artificial Sequence: Synthetic gluten peptide
QPFPQQPQQTYPQRPQQPFP

SEQ ID NO: 817 - protein, 16 aa, Artificial Sequence
  Description of Artificial Sequence: Synthetic gluten peptide
GQTYPQRPQQPFPQTG

SEQ ID NO: 818 - protein, 16 aa, Artificial Sequence
  Description of Artificial Sequence: Synthetic gluten peptide
GQTYPQRPEQPFPQTG

SEQ ID NO: 819 - protein, 20 aa, Artificial Sequence
  Description of Artificial Sequence: Synthetic gluten peptide
QQPFPQQPQQTYPQRPQQPF

SEQ ID NO: 820 - protein, 20 aa, Artificial Sequence
  Description of Artificial Sequence: Synthetic gluten peptide
QQPFPQQPQQTYPQRPQQPF

SEQ ID NO: 821 - protein, 20 aa, Artificial Sequence
  Description of Artificial Sequence: Synthetic gluten peptide
QQTYPQRPQQPFPQTQQPQQ

SEQ ID NO: 822 - protein, 20 aa, Artificial Sequence
  Description of Artificial Sequence: Synthetic gluten peptide
QTYPQRPQQPFPQTQQPQQP

SEQ ID NO: 823 - protein, 20 aa, Artificial Sequence
  Description of Artificial Sequence: Synthetic gluten peptide
YLQLQPFPQPQLPYPQPQLP

SEQ ID NO: 824 - protein, 20 aa, Artificial Sequence
  Description of Artificial Sequence: Synthetic gluten peptide
PYMQLQPFPQPQLPYPQPQL

SEQ ID NO: 825 - protein, 17 aa, Artificial Sequence
  Description of Artificial Sequence: Synthetic gluten peptide
QLQPFPQPQLPYPQPQL

SEQ ID NO: 826 - protein, 16 aa, Artificial Sequence
  Description of Artificial Sequence: Synthetic gluten peptide
GLQPFPQPELPYPQPG

SEQ ID NO: 827 - protein, 20 aa, Artificial Sequence
  Description of Artificial Sequence: Synthetic gluten peptide
LQLQPFPQPQLPYPQPQPFR

SEQ ID NO: 828 - protein, 17 aa, Artificial Sequence
  Description of Artificial Sequence: Synthetic gluten peptide
QLQPFPQPELPYPQPQP

SEQ ID NO: 829 - protein, 20 aa, Artificial Sequence
  Description of Artificial Sequence: Synthetic gluten peptide
LQLQPFPQPQLPYPQPQPFR

SEQ ID NO: 830 - protein, 33 aa, Artificial Sequence; identical to SEQ ID NO: 249
  Description of Artificial Sequence: Synthetic gluten peptide

SEQ ID NO: 831 - protein, 20 aa, Artificial Sequence
  Description of Artificial Sequence: Synthetic gluten peptide
MQLQPFPQPQLPYPQPQLPY

SEQ ID NO: 832 - protein, 16 aa, Artificial Sequence
  Description of Artificial Sequence: Synthetic gluten peptide
GLQPFPQPELPFPQPG

SEQ ID NO: 833 - protein, 17 aa, Artificial Sequence
  Description of Artificial Sequence: Synthetic gluten peptide
QLQPFPQPELPYPQPQL

SEQ ID NO: 834 - protein, 17 aa, Artificial Sequence
  Description of Artificial Sequence: Synthetic gluten peptide
QLQPFPQPQLPYPQPQP

SEQ ID NO: 835 - protein, 16 aa, Artificial Sequence
  Description of Artificial Sequence: Synthetic gluten peptide
GLQPFPQPQLPYPQPG

SEQ ID NO: 836 - protein, 20 aa, Artificial Sequence
  Description of Artificial Sequence: Synthetic gluten peptide
LQPFPQPELPYPQPELPYPF

SEQ ID NO: 837 - protein, 20 aa, Artificial Sequence
  Description of Artificial Sequence: Synthetic gluten peptide
LQLQPFPQPQLPYPQPQLPY

SEQ ID NO: 838 - protein, 16 aa, Artificial Sequence
  Description of Artificial Sequence: Synthetic gluten peptide
GLQPFPQPQLPFPQPG

SEQ ID NO: 839 - protein, 16 aa, Artificial Sequence
  Description of Artificial Sequence: Synthetic gluten peptide
GLQPFPQPELPYLQPG

SEQ ID NO: 840 - protein, 20 aa, Artificial Sequence
  Description of Artificial Sequence: Synthetic gluten peptide
PYLQLQPFPQPQLPYSQPQP

SEQ ID NO: 841 - protein, 16 aa, Artificial Sequence
  Description of Artificial Sequence: Synthetic gluten peptide
GLQPFPQPELPYSQPG

SEQ ID NO: 842 - protein, 20 aa, Artificial Sequence
  Description of Artificial Sequence: Synthetic gluten peptide
LQLQPFPQPQLPYLQPQPFR

SEQ ID NO: 843 - protein, 20 aa, Artificial Sequence
  Description of Artificial Sequence: Synthetic gluten peptide
LQLQPFPQPQLPYLQPQPFR

SEQ ID NO: 844 - protein, 20 aa, Artificial Sequence
  Description of Artificial Sequence: Synthetic gluten peptide
LQLQPFPQPQLPYSQPQPFR

SEQ ID NO: 845 - protein, 33 aa, Artificial Sequence; identical to SEQ ID NO: 263
  Description of Artificial Sequence: Synthetic gluten peptide

SEQ ID NO: 846 - protein, 16 aa, Artificial Sequence
  Description of Artificial Sequence: Synthetic gluten peptide
GLQPFPQPQLPYSQPG

SEQ ID NO: 847 - protein, 20 aa, Artificial Sequence
  Description of Artificial Sequence: Synthetic gluten peptide
LQLQPFPQPQLPYSQPQQFR

SEQ ID NO: 848 - protein, 16 aa, Artificial Sequence
  Description of Artificial Sequence: Synthetic gluten peptide
GLQPFPQPQLPYLQPG

SEQ ID NO: 849 - protein, 16 aa, Artificial Sequence
  Description of Artificial Sequence: Synthetic gluten peptide
GLQPFPQPELSYSQPG

SEQ ID NO: 850 - protein, 20 aa, Artificial Sequence
  Description of Artificial Sequence: Synthetic gluten peptide
QFPSQLPYLQLQPFPQPQLP

SEQ ID NO: 851 - protein, 20 aa, Artificial Sequence
  Description of Artificial Sequence: Synthetic gluten peptide
LQLQPFPQPQLSYSQPQPFR

SEQ ID NO: 852 - protein, 20 aa, Artificial Sequence
  Description of Artificial Sequence: Synthetic gluten peptide
LQLQPFPQPQLSYSQPQPFR

SEQ ID NO: 853 - protein, 15 aa, Artificial Sequence
  Description of Artificial Sequence: Synthetic gluten peptide
GSGLQPFPQPELGSG

SEQ ID NO: 854 - protein, 20 aa, Artificial Sequence
  Description of Artificial Sequence: Synthetic gluten peptide
PFPSQQPYMQLQPFPQPQLP

SEQ ID NO: 855 - protein, 16 aa, Artificial Sequence
  Description of Artificial Sequence: Synthetic gluten peptide
GLQPFPQPQLSYSQPG

SEQ ID NO: 856 - protein, 20 aa, Artificial Sequence
  Description of Artificial Sequence: Synthetic gluten peptide
PFPSQLPYLQLQPFPQPQLP

SEQ ID NO: 857 - protein, 20 aa, Artificial Sequence
  Description of Artificial Sequence: Synthetic gluten peptide
PFPSQQPYLQLQPFPQPQLP

SEQ ID NO: 858 - protein, 20 aa, Artificial Sequence
  Description of Artificial Sequence: Synthetic gluten peptide
PFPSQQPYLQLQPFPQPQLP

SEQ ID NO: 859 - protein, 20 aa, Artificial Sequence
  Description of Artificial Sequence: Synthetic gluten peptide
PFPWQPQQPFPQTQQSFPLQ

SEQ ID NO: 860 - protein, 20 aa, Artificial Sequence
  Description of Artificial Sequence: Synthetic gluten peptide
QPFPQTQQSFPLQPQQPFPQ

SEQ ID NO: 861 - protein, 20 aa, Artificial Sequence
  Description of Artificial Sequence: Synthetic gluten peptide
FPWQPQQPFPQTQQSFPLQP

SEQ ID NO: 862 - protein, 20 aa, Artificial Sequence
  Description of Artificial Sequence: Synthetic gluten peptide
METSCIPGLERPWQQQPLQQ

SEQ ID NO: 863 - protein, 20 aa, Artificial Sequence
  Description of Artificial Sequence: Synthetic gluten peptide
ETSCIPGLERPWQEQPLPPQ

SEQ ID NO: 864 - protein, 20 aa, Artificial Sequence
  Description of Artificial Sequence: Synthetic gluten peptide
SQQQPILPRGPPFSQQTQPV

SEQ ID NO: 865 - protein, 16 aa, Artificial Sequence
  Description of Artificial Sequence: Synthetic gluten peptide
GFFPQPEQEFPQPQQG

SEQ ID NO: 866 - protein, 16 aa, Artificial Sequence
  Description of Artificial Sequence: Synthetic gluten peptide
GQQPFPQPEQEFPQPG

SEQ ID NO: 867 - protein, 20 aa, Artificial Sequence
  Description of Artificial Sequence: Synthetic gluten peptide
SQQPQQPFPQPQQQFPQPQQ

SEQ ID NO: 868 - protein, 16 aa, Artificial Sequence
  Description of Artificial Sequence: Synthetic gluten peptide
GQQPFPQPEQQFPQPG

SEQ ID NO: 869 - protein, 20 aa, Artificial Sequence
  Description of Artificial Sequence: Synthetic gluten peptide
SQQPQQPFPQPQQQFPQPQQ

SEQ ID NO: 870 - protein, 20 aa, Artificial Sequence
  Description of Artificial Sequence: Synthetic gluten peptide
PQQPFPQQPQQQFPQPQQPQ

SEQ ID NO: 871 - protein, 20 aa, Artificial Sequence
  Description of Artificial Sequence: Synthetic gluten peptide
QPFPQPQQQFPQPQQPQQSF

SEQ ID NO: 872 - protein, 16 aa, Artificial Sequence
  Description of Artificial Sequence: Synthetic gluten peptide
GQPFPQQPEQEFPQPG

SEQ ID NO: 873 - protein, 20 aa, Artificial Sequence
  Description of Artificial Sequence: Synthetic gluten peptide
QQPQQPFPQQPQQQFPQPQQ

SEQ ID NO: 874 - protein, 16 aa, Artificial Sequence
  Description of Artificial Sequence: Synthetic gluten peptide
GQQQFSQPEQEFPQPG

SEQ ID NO: 875 - protein, 16 aa, Artificial Sequence
  Description of Artificial Sequence: Synthetic gluten peptide
GFFPQPQQEFPQPQQG

SEQ ID NO: 876 - protein, 20 aa, Artificial Sequence
  Description of Artificial Sequence: Synthetic gluten peptide
SQQPQQPFPQPQQQFPQPQQ

SEQ ID NO: 877 - protein, 16 aa, Artificial Sequence
  Description of Artificial Sequence: Synthetic gluten peptide
GFFPQPQQQFPQPQQG

SEQ ID NO: 878 - protein, 16 aa, Artificial Sequence
  Description of Artificial Sequence: Synthetic gluten peptide
GQQQFSQPQQQFPQPG

SEQ ID NO: 879 - protein, 16 aa, Artificial Sequence
  Description of Artificial Sequence: Synthetic gluten peptide
GQPFPQQPEQQFPQPG

SEQ ID NO: 880 - protein, 16 aa, Artificial Sequence
  Description of Artificial Sequence: Synthetic gluten peptide
GQQPFPQPQQQFPQPG

SEQ ID NO: 881 - protein, 20 aa, Artificial Sequence
  Description of Artificial Sequence: Synthetic gluten peptide
QQPQQQFPQPQQPQQPFPQP

SEQ ID NO: 882 - protein, 16 aa, Artificial Sequence
  Description of Artificial Sequence: Synthetic gluten peptide
GQTFPHQPEQQFPQPG

SEQ ID NO: 883 - protein, 16 aa, Artificial Sequence
  Description of Artificial Sequence: Synthetic gluten peptide
GFPQQPEQEFPQPQQG

SEQ ID NO: 884 - protein, 20 aa, Artificial Sequence
  Description of Artificial Sequence: Synthetic gluten peptide
PQQPFPQQPQQQFPQPQQPQ

SEQ ID NO: 885 - protein, 16 aa, Artificial Sequence
  Description of Artificial Sequence: Synthetic gluten peptide
GQQQFSQPEQQFPQPG

SEQ ID NO: 886 - protein, 16 aa, Artificial Sequence
  Description of Artificial Sequence: Synthetic gluten peptide
GFFSQPQQEFPQPQQG

SEQ ID NO: 887 - protein, 20 aa, Artificial Sequence
  Description of Artificial Sequence: Synthetic gluten peptide
PQPQQQFPQPQQPQQSFPQQ

SEQ ID NO: 888 - protein, 16 aa, Artificial Sequence
  Description of Artificial Sequence: Synthetic gluten peptide
GFPQQPQQEFPQPQQG

SEQ ID NO: 889 - protein, 20 aa, Artificial Sequence
  Description of Artificial Sequence: Synthetic gluten peptide
SQQPQQQFSQPQQQFPQPQQ

SEQ ID NO: 890 - protein, 20 aa, Artificial Sequence
  Description of Artificial Sequence: Synthetic gluten peptide
SQQPQQQFSQPQQQFPQPQQ

SEQ ID NO: 891 - protein, 15 aa, Artificial Sequence
  Description of Artificial Sequence: Synthetic gluten peptide
QQFSQPEQEFPQPQQ

SEQ ID NO: 892 - protein, 20 aa, Artificial Sequence
  Description of Artificial Sequence: Synthetic gluten peptide
QSQQPQQQFSQPQQQFPQPQ

SEQ ID NO: 893 - protein, 20 aa, Artificial Sequence
  Description of Artificial Sequence: Synthetic gluten peptide
QPQQQFSQPQQQFPQPQQPQ

SEQ ID NO: 894 - protein, 16 aa, Artificial Sequence
  Description of Artificial Sequence: Synthetic gluten peptide
GQPFPQQPQQQFPQPG

SEQ ID NO: 895 - protein, 20 aa, Artificial Sequence
  Description of Artificial Sequence: Synthetic gluten peptide
QQPQQPFPQQPQQQFPQPQQ

SEQ ID NO: 896 - protein, 20 aa, Artificial Sequence
  Description of Artificial Sequence: Synthetic gluten peptide
PQQPQQPFPQQPQQQFPQPQ

SEQ ID NO: 897 - protein, 20 aa, Artificial Sequence
  Description of Artificial Sequence: Synthetic gluten peptide
TFPQPQQTCPHQPQQQFPQP

SEQ ID NO: 898 - protein, 16 aa, Artificial Sequence
  Description of Artificial Sequence: Synthetic gluten peptide
GFFSQPQQQFPQPQQG

SEQ ID NO: 899 - protein, 20 aa, Artificial Sequence
  Description of Artificial Sequence: Synthetic gluten peptide
TFPHQPQQQFPQPQQPQQPF

SEQ ID NO: 900 - protein, 20 aa, Artificial Sequence
  Description of Artificial Sequence: Synthetic gluten peptide
QTFPHQPQQQFPQPQQPQQQ

SEQ ID NO: 901 - protein, 16 aa, Artificial Sequence
  Description of Artificial Sequence: Synthetic gluten peptide
GFPQQPQQQFPQPQQG

SEQ ID NO: 902 - protein, 20 aa, Artificial Sequence
  Description of Artificial Sequence: Synthetic gluten peptide
SQPQQQFPQPQQPQQSFPQQ

SEQ ID NO: 903 - protein, 20 aa, Artificial Sequence
  Description of Artificial Sequence: Synthetic gluten peptide
QTCPHQPQQQFPQPQQPQQP

SEQ ID NO: 904 - protein, 16 aa, Artificial Sequence
  Description of Artificial Sequence: Synthetic gluten peptide
GQTFPHQPQQQFPQPG

SEQ ID NO: 905 - protein, 20 aa, Artificial Sequence
  Description of Artificial Sequence: Synthetic gluten peptide
NMQADPSGQVQWPQQQPFLQ

SEQ ID NO: 906 - protein, 20 aa, Artificial Sequence
  Description of Artificial Sequence: Synthetic gluten peptide
ATANMQADPSGQVQWPQQQP

SEQ ID NO: 907 - protein, 20 aa, Artificial Sequence
  Description of Artificial Sequence: Synthetic gluten peptide
FDEEKNSTGALCSSLSNQAS

SEQ ID NO: 908 - protein, 20 aa, Artificial Sequence
  Description of Artificial Sequence: Synthetic gluten peptide
QPPFPQQHQQFPQQQIPVVQ

SEQ ID NO: 909 - protein, 20 aa, Artificial Sequence
  Description of Artificial Sequence: Synthetic gluten peptide
QQPLFPQQHQQFPQQQIPVV

SEQ ID NO: 910 - protein, 20 aa, Artificial Sequence
  Description of Artificial Sequence: Synthetic gluten peptide
QFPQQQIPVVQPSVLQQLNP

SEQ ID NO: 911 - protein, 20 aa, Artificial Sequence
  Description of Artificial Sequence: Synthetic gluten peptide
SQQQQPFPQQQQPLLLQQPP

SEQ ID NO: 912 - protein, 20 aa, Artificial Sequence
  Description of Artificial Sequence: Synthetic gluten peptide
QQQQPILLQQPPFSQHQQPV

SEQ ID NO: 913 - protein, 20 aa, Artificial Sequence
  Description of Artificial Sequence: Synthetic gluten peptide
QQQPFPQQQQPLLLQQPPFS

SEQ ID NO: 914 - protein, 20 aa, Artificial Sequence
  Description of Artificial Sequence: Synthetic gluten peptide
QQQQPPFSQQQQQPILLQQP

SEQ ID NO: 915 - protein, 20 aa, Artificial Sequence
  Description of Artificial Sequence: Synthetic gluten peptide
PFSQQQQPVLLQQQIPFVHP

SEQ ID NO: 916 - protein, 20 aa, Artificial Sequence
  Description of Artificial Sequence: Synthetic gluten peptide
QQQPFPQQQQPLLLQQPPFS

SEQ ID NO: 917 - protein, 20 aa, Artificial Sequence
  Description of Artificial Sequence: Synthetic gluten peptide
QQPLSQQPQQTFPQPQQTFP

SEQ ID NO: 918 - protein, 20 aa, Artificial Sequence
  Description of Artificial Sequence: Synthetic gluten peptide
HQPFSQQPQQTFPQPQQTFP

SEQ ID NO: 919 - protein, 20 aa, Artificial Sequence
  Description of Artificial Sequence: Synthetic gluten peptide
QPFPQPHQPFSQQPQQTFPQ

SEQ ID NO: 920 - protein, 16 aa, Artificial Sequence
  Description of Artificial Sequence: Synthetic gluten peptide
GQPLSQQPQQTFPQQG

SEQ ID NO: 921 - protein, 20 aa, Artificial Sequence
  Description of Artificial Sequence: Synthetic gluten peptide
PVPQPHQPFSQQPQQTFPQP

SEQ ID NO: 922 - protein, 16 aa, Artificial Sequence
  Description of Artificial Sequence: Synthetic gluten peptide
GQPLSQQPEQTFPQQG

SEQ ID NO: 923 - protein, 20 aa, Artificial Sequence
  Description of Artificial Sequence: Synthetic gluten peptide
QQLVPQLQQPLSQQPQQTFP

SEQ ID NO: 924 - protein, 20 aa, Artificial Sequence
  Description of Artificial Sequence: Synthetic gluten peptide
PQLQQPLSQQPQQTFPQPQQ

SEQ ID NO: 925 - protein, 20 aa, Artificial Sequence
  Description of Artificial Sequence: Synthetic gluten peptide
PHQTFHHQPQQTFPQPQQTY

SEQ ID NO: 926 - protein, 20 aa, Artificial Sequence
  Description of Artificial Sequence: Synthetic gluten peptide
QTFHHQPQQTFPQPEQTYPH

SEQ ID NO: 927 - protein, 20 aa, Artificial Sequence
  Description of Artificial Sequence: Synthetic gluten peptide
QTFHHQPQQTFPQPQQTYPH

SEQ ID NO: 928 - protein, 20 aa, Artificial Sequence
  Description of Artificial Sequence: Synthetic gluten peptide
QRTIPQPHQTFHHQPQQTFP

SEQ ID NO: 929 - protein, 20 aa, Artificial Sequence
  Description of Artificial Sequence: Synthetic gluten peptide
SGQGQHWYYPTSPKLSGQGQ

SEQ ID NO: 930 - protein, 20 aa, Artificial Sequence
  Description of Artificial Sequence: Synthetic gluten peptide
TFPHQPQQQFSQPQQPQQQF

SEQ ID NO: 931 - protein, 20 aa, Artificial Sequence
  Description of Artificial Sequence: Synthetic gluten peptide
QTFPHQPQQQFSQPQQPQQQ

SEQ ID NO: 932 - protein, 20 aa, Artificial Sequence
  Description of Artificial Sequence: Synthetic gluten peptide
QQQTLQQILQQQLIPCRDVV

SEQ ID NO: 933 - protein, 20 aa, Artificial Sequence
  Description of Artificial Sequence: Synthetic gluten peptide
TLQQILQQQLIPCRDVVLQQ

SEQ ID NO: 934 - protein, 20 aa, Artificial Sequence
  Description of Artificial Sequence: Synthetic gluten peptide
QQQQQQQQTLQQILQQQLIP

SEQ ID NO: 935 - protein, 20 aa, Artificial Sequence
  Description of Artificial Sequence: Synthetic gluten peptide
PWLQQPLPPQQTLPQQLQQP

SEQ ID NO: 936 - protein, 20 aa, Artificial Sequence
  Description of Artificial Sequence: Synthetic gluten peptide
SNIIISFLKPWLQQPLPPQQ

SEQ ID NO: 937 - protein, 20 aa, Artificial Sequence
  Description of Artificial Sequence: Synthetic gluten peptide
QGQQGYYPISPQQSGQGQQP

SEQ ID NO: 938 - protein, 20 aa, Artificial Sequence
  Description of Artificial Sequence: Synthetic gluten peptide
PYPQPQPFPQPQPFPPQLPY

SEQ ID NO: 939 - protein, 20 aa, Artificial Sequence
  Description of Artificial Sequence: Synthetic gluten peptide
PFPSQQPYPQPQPFPQPQPF

SEQ ID NO: 940 - protein, 20 aa, Artificial Sequence
  Description of Artificial Sequence: Synthetic gluten peptide
PQPQPFPQPQPFPPQLPYPQ

SEQ ID NO: 941 - protein, 20 aa, Artificial Sequence
  Description of Artificial Sequence: Synthetic gluten peptide
PYPQPQPFPQPQPFPPQLPY

SEQ ID NO: 942 - protein, 20 aa, Artificial Sequence
  Description of Artificial Sequence: Synthetic gluten peptide
QQPFPSQQPYPQPQPFPQPQ

SEQ ID NO: 943 - protein, 20 aa, Artificial Sequence
  Description of Artificial Sequence: Synthetic gluten peptide
PFPSQQPYPQPQPFPQPQPF

SEQ ID NO: 944 - protein, 20 aa, Artificial Sequence
  Description of Artificial Sequence: Synthetic gluten peptide
PQPQPFPQPQPFPPQLPYPQ

SEQ ID NO: 945 - protein, 20 aa, Artificial Sequence
  Description of Artificial Sequence: Synthetic gluten peptide
PQQQFIQPQQPFPQQPQQTY

SEQ ID NO: 946 - protein, 20 aa, Artificial Sequence
  Description of Artificial Sequence: Synthetic gluten peptide
QQQFIQPQQPFPQQPQQTYP

SEQ ID NO: 947 - protein, 20 aa, Artificial Sequence
  Description of Artificial Sequence: Synthetic gluten peptide
PQQQFIQPQQPFPQQPQQTY

SEQ ID NO: 948 - protein, 20 aa, Artificial Sequence
  Description of Artificial Sequence: Synthetic gluten peptide
PQQPQQPFPQQPQQSFPQQP

SEQ ID NO: 949 - protein, 16 aa, Artificial Sequence
  Description of Artificial Sequence: Synthetic gluten peptide
GQPFPQQPEQSFPQQG

SEQ ID NO: 950 - protein, 20 aa, Artificial Sequence
  Description of Artificial Sequence: Synthetic gluten peptide
QPFPQQPQQTYPQRPQQPFP

SEQ ID NO: 951 - protein, 16 aa, Artificial Sequence
  Description of Artificial Sequence: Synthetic gluten peptide
GQPQQPFPEQPQQSFG

SEQ ID NO: 952 - protein, 16 aa, Artificial Sequence
  Description of Artificial Sequence: Synthetic gluten peptide
GQPQQPFPQQPQQSFG

SEQ ID NO: 953 - protein, 20 aa, Artificial Sequence
  Description of Artificial Sequence: Synthetic gluten peptide
PQQPFPQQPQQSFPQQPQQP

SEQ ID NO: 954 - protein, 20 aa, Artificial Sequence
  Description of Artificial Sequence: Synthetic gluten peptide
PQQPFPQQPQQTYPQRPQQP

SEQ ID NO: 955 - protein, 16 aa, Artificial Sequence
  Description of Artificial Sequence: Synthetic gluten peptide
GQPFPQQPQQSFPQQG

SEQ ID NO: 956 - protein, 16 aa, Artificial Sequence
  Description of Artificial Sequence: Synthetic gluten peptide
GQPQQPFPEQPQQTFG

SEQ ID NO: 957 - protein, 20 aa, Artificial Sequence
  Description of Artificial Sequence: Synthetic gluten peptide
PFPQQPQQPFPQQPQQSFPQ

SEQ ID NO: 958 - protein, 16 aa, Artificial Sequence
  Description of Artificial Sequence: Synthetic gluten peptide
GQPQQPFPQQPQQTFG

SEQ ID NO: 959 - protein, 20 aa, Artificial Sequence
  Description of Artificial Sequence: Synthetic gluten peptide
QQPFPQQPQQTYPQRPQQPF

SEQ ID NO: 960 - protein, 20 aa, Artificial Sequence
  Description of Artificial Sequence: Synthetic gluten peptide
QQPFPQQPQQTYPQRPQQPF

SEQ ID NO: 961 - protein, 20 aa, Artificial Sequence
  Description of Artificial Sequence: Synthetic gluten peptide
PWQQQPLPPQQSFSQQPPFS

SEQ ID NO: 962 - protein, 20 aa, Artificial Sequence
  Description of Artificial Sequence: Synthetic gluten peptide
PWQQQPLPPQQSFSQQPPFS

SEQ ID NO: 963 - protein, 20 aa, Artificial Sequence
  Description of Artificial Sequence: Synthetic gluten peptide
ERPWQQQPLPPQQSFSQQPP

SEQ ID NO: 964 - protein, 20 aa, Artificial Sequence
  Description of Artificial Sequence: Synthetic gluten peptide
PQQSFSQQPPFSQQQQQPLP

SEQ ID NO: 965 - protein, 20 aa, Artificial Sequence
  Description of Artificial Sequence: Synthetic gluten peptide
QQSFSQQPPFSQQQQQPLPQ

SEQ ID NO: 966 - protein, 20 aa, Artificial Sequence
  Description of Artificial Sequence: Synthetic gluten peptide
QPLPPQQSFSQQPPFSQQQQ

SEQ ID NO: 967 - protein, 20 aa, Artificial Sequence
  Description of Artificial Sequence: Synthetic gluten peptide
PWQQQPLPPQQSFSQQPPFS

SEQ ID NO: 968 - protein, 20 aa, Artificial Sequence
  Description of Artificial Sequence: Synthetic gluten peptide
YPQQPFPQQPQQPFPQQPPF

SEQ ID NO: 969 - protein, 20 aa, Artificial Sequence
  Description of Artificial Sequence: Synthetic gluten peptide
YQQQPFPQQPYPQQPYPSQQ

SEQ ID NO: 970 - protein, 20 aa, Artificial Sequence
  Description of Artificial Sequence: Synthetic gluten peptide
LPQPYAQPYLPYPQQPFPQQ

SEQ ID NO: 971 - protein, 20 aa, Artificial Sequence
  Description of Artificial Sequence: Synthetic gluten peptide
PQQSFSYQQQPFPQQPYPQQ

SEQ ID NO: 972 - protein, 20 aa, Artificial Sequence
  Description of Artificial Sequence: Synthetic gluten peptide
PFPQQPYPQQPYPSQQPYPS

SEQ ID NO: 973 - protein, 20 aa, Artificial Sequence
  Description of Artificial Sequence: Synthetic gluten peptide
QELQSPQQLYPQQPYPQQPY

SEQ ID NO: 974 - protein, 20 aa, Artificial Sequence
  Description of Artificial Sequence: Synthetic gluten peptide
YAQPYLPYPQQPFPQQPQQP

SEQ ID NO: 975 - protein, 20 aa, Artificial Sequence
  Description of Artificial Sequence: Synthetic gluten peptide
QQPFPQQPYPQQPYPSQQPY

SEQ ID NO: 976 - protein, 20 aa, Artificial Sequence
  Description of Artificial Sequence: Synthetic gluten peptide
QPSSQQPLSQQHQQFPQQQI

SEQ ID NO: 977 - protein, 20 aa, Artificial Sequence
  Description of Artificial Sequence: Synthetic gluten peptide
QQPPFSQQQQPSSQQPLSQQ

SEQ ID NO: 978 - protein, 20 aa, Artificial Sequence
  Description of Artificial Sequence: Synthetic gluten peptide
GLERPWQQQPLQQKETFPQQ

SEQ ID NO: 979 - protein, 20 aa, Artificial Sequence
  Description of Artificial Sequence: Synthetic gluten peptide
QQGYYPISPQQLGQGQQSGQ

SEQ ID NO: 980 - protein, 20 aa, Artificial Sequence
  Description of Artificial Sequence: Synthetic gluten peptide
QSSCHVMQQQCCQRLPQIPE

SEQ ID NO: 981 - protein, 20 aa, Artificial Sequence
  Description of Artificial Sequence: Synthetic gluten peptide
GQQAGQGQQGYYPTSPQQLG

SEQ ID NO: 982 - protein, 20 aa, Artificial Sequence
  Description of Artificial Sequence: Synthetic gluten peptide
GQVQWPQQQPFPQPQQPFCE

SEQ ID NO: 983 - protein, 20 aa, Artificial Sequence
  Description of Artificial Sequence: Synthetic gluten peptide
PQQQQPFPQPQQPFSQQPQQ

SEQ ID NO: 984 - protein, 20 aa, Artificial Sequence
  Description of Artificial Sequence: Synthetic gluten peptide
WPQQQPFPQPQQPFCQQPQQ

SEQ ID NO: 985 - protein, 20 aa, Artificial Sequence
  Description of Artificial Sequence: Synthetic gluten peptide
QQQQPFPQPQQPQQPFPQPQ

SEQ ID NO: 986 - protein, 20 aa, Artificial Sequence
  Description of Artificial Sequence: Synthetic gluten peptide
PSGQVQWPQQQPFPQPQQPF

SEQ ID NO: 987 - protein, 20 aa, Artificial Sequence
  Description of Artificial Sequence: Synthetic gluten peptide
PQQQPFPQPQQPFCEQPQRT

SEQ ID NO: 988 - protein, 20 aa, Artificial Sequence
  Description of Artificial Sequence: Synthetic gluten peptide
QQQPFPQPQQPFCQQPQRTI

SEQ ID NO: 989 - protein, 20 aa, Artificial Sequence
  Description of Artificial Sequence: Synthetic gluten peptide
PSGQVQWPQQQQPFPQPQQP

SEQ ID NO: 990 - protein, 20 aa, Artificial Sequence
  Description of Artificial Sequence: Synthetic gluten peptide
QQQQPFPQPQQPFSQQPQQI

SEQ ID NO: 991 - protein, 20 aa, Artificial Sequence
  Description of Artificial Sequence: Synthetic gluten peptide
GQVQWPQQQQPFPQPQQPQQ

SEQ ID NO: 992 - protein, 20 aa, Artificial Sequence
  Description of Artificial Sequence: Synthetic gluten peptide
PSGQVQWPQQQQPFPQPQQP

SEQ ID NO: 993 - protein, 20 aa, Artificial Sequence
  Description of Artificial Sequence: Synthetic gluten peptide
QQQPFPQPQQPFCEQPQRTI

SEQ ID NO: 994 - protein, 20 aa, Artificial Sequence
  Description of Artificial Sequence: Synthetic gluten peptide
VDPSGQVQWPQQQQPFPQPQ

SEQ ID NO: 995 - protein, 20 aa, Artificial Sequence
  Description of Artificial Sequence: Synthetic gluten peptide
PSGQVQWPQQQQPFPQPQQP

SEQ ID NO: 996 - protein, 20 aa, Artificial Sequence
  Description of Artificial Sequence: Synthetic gluten peptide
NIQVDPSGQVQWPQQQQPFP

SEQ ID NO: 997 - protein, 20 aa, Artificial Sequence
  Description of Artificial Sequence: Synthetic gluten peptide
GQVQWPQQQQPFPQPQQPQQ

SEQ ID NO: 998 - protein, 20 aa, Artificial Sequence
  Description of Artificial Sequence: Synthetic gluten peptide
PSGQVQWPQQQQPFPQPQQP

SEQ ID NO: 999 - protein, 20 aa, Artificial Sequence
  Description of Artificial Sequence: Synthetic gluten peptide
TTANIQVDPSGQVQWPQQQQ

SEQ ID NO: 1000 - protein, 20 aa, Artificial Sequence
  Description of Artificial Sequence: Synthetic gluten peptide
VDPSGQVQWPQQQQPFPQPQ

SEQ ID NO: 1001 - protein, 19 aa, Artificial Sequence
  Description of Artificial Sequence: Synthetic gluten peptide
QIVFPSGQVQWPQQQQPFP

SEQ ID NO: 1002 - protein, 16 aa, Artificial Sequence
  Description of Artificial Sequence: Synthetic gluten peptide
GQVQWPQQEQPFPQQG

SEQ ID NO: 1003 - protein, 16 aa, Artificial Sequence
  Description of Artificial Sequence: Synthetic gluten peptide
GQVQWPQQQQPFPQQG

SEQ ID NO: 1004 - protein, 20 aa, Artificial Sequence
  Description of Artificial Sequence: Synthetic gluten peptide
QSTYQPLQQLCCQQLWQIPE

SEQ ID NO: 1005 - protein, 20 aa, Artificial Sequence
  Description of Artificial Sequence: Synthetic gluten peptide
QSTYQPLQQLCCQQLWQIPE

SEQ ID NO: 1006 - protein, 20 aa, Artificial Sequence
  Description of Artificial Sequence: Synthetic gluten peptide
QSTYQPLQQLCCQQLWQIPE

SEQ ID NO: 1007 - protein, 20 aa, Artificial Sequence
  Description of Artificial Sequence: Synthetic gluten peptide
PPQQPYPQPQFPSQLPYLQL

SEQ ID NO: 1008 - protein, 20 aa, Artificial Sequence
  Description of Artificial Sequence: Synthetic gluten peptide
GQQQPFPPQQPYPQPQFPSQ

SEQ ID NO: 1009 - protein, 20 aa, Artificial Sequence
  Description of Artificial Sequence: Synthetic gluten peptide
QQPFPPQQPYPQPQFPSQLP

SEQ ID NO: 1010 - protein, 20 aa, Artificial Sequence
  Description of Artificial Sequence: Synthetic gluten peptide
QQPYPQPQFPSQLPYLQLQP

SEQ ID NO: 1011 - protein, 20 aa, Artificial Sequence
  Description of Artificial Sequence: Synthetic gluten peptide
FEEIRNLALQTLPSMCNVYI

SEQ ID NO: 1012 - protein, 20 aa, Artificial Sequence
  Description of Artificial Sequence: Synthetic gluten peptide
RNLALQTLPSMCNVYIPPYC

SEQ ID NO: 1013 - protein, 20 aa, Artificial Sequence
  Description of Artificial Sequence: Synthetic gluten peptide
EIRNLALQTLPSMCNVYIPP

SEQ ID NO: 1014 - protein, 20 aa, Artificial Sequence
  Description of Artificial Sequence: Synthetic gluten peptide
ELCCQHLWQIPEKLQCQAIH

SEQ ID NO: 1015 - protein, 20 aa, Artificial Sequence
  Description of Artificial Sequence: Synthetic gluten peptide
ELCCQHLWQIPEKLQCQAIH

SEQ ID NO: 1016 - protein, 16 aa, Artificial Sequence
  Description of Artificial Sequence: Synthetic gluten peptide
GLCCQHLWEIPEKLQG

SEQ ID NO: 1017 - protein, 16 aa, Artificial Sequence
  Description of Artificial Sequence: Synthetic gluten peptide
GLCCQHLWQIPEKLQG

SEQ ID NO: 1018 - protein, 20 aa, Artificial Sequence
  Description of Artificial Sequence: Synthetic gluten peptide
LCCQHLWQIPEKLQCQAIHN

SEQ ID NO: 1019 - protein, 20 aa, Artificial Sequence
  Description of Artificial Sequence: Synthetic gluten peptide
PFPWQPQQPFPQTQQSFPLQ

SEQ ID NO: 1020 - protein, 20 aa, Artificial Sequence
  Description of Artificial Sequence: Synthetic gluten peptide
QPFPQTQQSFPLQPQQPFPQ

SEQ ID NO: 1021 - protein, 20 aa, Artificial Sequence
  Description of Artificial Sequence: Synthetic gluten peptide
FPWQPQQPFPQTQQSFPLQP

SEQ ID NO: 1022 - protein, 20 aa, Artificial Sequence
  Description of Artificial Sequence: Synthetic gluten peptide
PFPQTQQSFPLQPQQPFPQQ

SEQ ID NO: 1023 - protein, 20 aa, Artificial Sequence
  Description of Artificial Sequence: Synthetic gluten peptide
GQGFFQPSQQNPQAQGSFQP

SEQ ID NO: 1024 - protein, 16 aa, Artificial Sequence
  Description of Artificial Sequence: Synthetic gluten peptide
GQGFFQPSQQNPQAQG

SEQ ID NO: 1025 - protein, 20 aa, Artificial Sequence
  Description of Artificial Sequence: Synthetic gluten peptide
QQYPSGQGFFQPSQQNPQAQ

SEQ ID NO: 1026 - protein, 20 aa, Artificial Sequence
  Description of Artificial Sequence: Synthetic gluten peptide
QQYPSGQGFFQPSQQNPQAQ

SEQ ID NO: 1027 - protein, 16 aa, Artificial Sequence
  Description of Artificial Sequence: Synthetic gluten peptide
GQGFFQPSEQNPQAQG

SEQ ID NO: 1028 - protein, 20 aa, Artificial Sequence
  Description of Artificial Sequence: Synthetic gluten peptide
PSGQGFFQPSQQNPQAQGSF

SEQ ID NO: 1029 - protein, 20 aa, Artificial Sequence
  Description of Artificial Sequence: Synthetic gluten peptide
QQYPSGQGFFQPSQQNPQAQ

SEQ ID NO: 1030 - protein, 20 aa, Artificial Sequence
  Description of Artificial Sequence: Synthetic gluten peptide
ARSQTLWQSSCHVMQQQCCR

SEQ ID NO: 1031 - protein, 20 aa, Artificial Sequence
  Description of Artificial Sequence: Synthetic gluten peptide
LLQQCKPVSLVSSLWSIILP

SEQ ID NO: 1032 - protein, 20 aa, Artificial Sequence
  Description of Artificial Sequence: Synthetic gluten peptide
LVSSLWSIILPPSDCQVMRQ

SEQ ID NO: 1033 - protein, 20 aa, Artificial Sequence
  Description of Artificial Sequence: Synthetic gluten peptide
LVSSLWSIILPPSDCQVMRQ

SEQ ID NO: 1034 - protein, 16 aa, Artificial Sequence
  Description of Artificial Sequence: Synthetic gluten peptide
GQQTFPQPEQTFPHQG

SEQ ID NO: 1035 - protein, 20 aa, Artificial Sequence
  Description of Artificial Sequence: Synthetic gluten peptide
QQTFPQPQQTFPHQPQQQFP

SEQ ID NO: 1036 - protein, 16 aa, Artificial Sequence
  Description of Artificial Sequence: Synthetic gluten peptide
GQQTFPQPQQTFPHQG

SEQ ID NO: 1037 - protein, 20 aa, Artificial Sequence
  Description of Artificial Sequence: Synthetic gluten peptide
QQPQQTFPQPQQTFPHQPQQ

SEQ ID NO: 1038 - protein, 20 aa, Artificial Sequence
  Description of Artificial Sequence: Synthetic gluten peptide
PHQTFHHQPQQTFPQPQQTY

SEQ ID NO: 1039 - protein, 20 aa, Artificial Sequence
  Description of Artificial Sequence: Synthetic gluten peptide
QQPLSQQPQQTFPQPQQTFP

SEQ ID NO: 1040 - protein, 20 aa, Artificial Sequence
  Description of Artificial Sequence: Synthetic gluten peptide
QTFPQPQQTYPHQPQQQFPQ

SEQ ID NO: 1041 - protein, 20 aa, Artificial Sequence
  Description of Artificial Sequence: Synthetic gluten peptide
HQPFSQQPQQTFPQPQQTFP

SEQ ID NO: 1042 - protein, 20 aa, Artificial Sequence
  Description of Artificial Sequence: Synthetic gluten peptide
QQTFPQPQQTFPHQPQQQVP

SEQ ID NO: 1043 - protein, 20 aa, Artificial Sequence
  Description of Artificial Sequence: Synthetic gluten peptide
QTFPQPEQTYPHQPQQQFPQ

SEQ ID NO: 1044 - protein, 20 aa, Artificial Sequence
  Description of Artificial Sequence: Synthetic gluten peptide
QTFHHQPQQTFPQPEQTYPH

SEQ ID NO: 1045 - protein, 20 aa, Artificial Sequence
  Description of Artificial Sequence: Synthetic gluten peptide
HHQPQQTFPQPEQTYPHQPQ

SEQ ID NO: 1046 - protein, 20 aa, Artificial Sequence
  Description of Artificial Sequence: Synthetic gluten peptide
QQTFPQPQQTFPHQPQQQFS

SEQ ID NO: 1047 - protein, 20 aa, Artificial Sequence
  Description of Artificial Sequence: Synthetic gluten peptide
QTFPQPQQTYPHQPQQQFPQ

SEQ ID NO: 1048 - protein, 20 aa, Artificial Sequence
  Description of Artificial Sequence: Synthetic gluten peptide
QTFHHQPQQTFPQPQQTYPH

SEQ ID NO: 1049 - protein, 20 aa, Artificial Sequence
  Description of Artificial Sequence: Synthetic gluten peptide
HHQPQQTFPQPQQTYPHQPQ

SEQ ID NO: 1050 - protein, 20 aa, Artificial Sequence
  Description of Artificial Sequence: Synthetic gluten peptide
MENSHIPGLERPSRQQPLPP

SEQ ID NO: 1051 - protein, 20 aa, Artificial Sequence
  Description of Artificial Sequence: Synthetic gluten peptide
MENSHIPGLERLSQQQPLPP

SEQ ID NO: 1052 - protein, 20 aa, Artificial Sequence
  Description of Artificial Sequence: Synthetic gluten peptide
MENSHIPGLEGPSQQQPLPP

SEQ ID NO: 1053 - protein, 20 aa, Artificial Sequence
  Description of Artificial Sequence: Synthetic gluten peptide
KVFLQQQCSPVAIPYRLARS

SEQ ID NO: 1054 - protein, 20 aa, Artificial Sequence
  Description of Artificial Sequence: Synthetic gluten peptide
QPPFSQQQQTPFSQQQQIPV

SEQ ID NO: 1055 - protein, 20 aa, Artificial Sequence
  Description of Artificial Sequence: Synthetic gluten peptide
SQQQQPPFSQQQQIPVIHPS

SEQ ID NO: 1056 - protein, 20 aa, Artificial Sequence
  Description of Artificial Sequence: Synthetic gluten peptide
QQQQTPFSQQQQIPVIHPSV

SEQ ID NO: 1057 - protein, 20 aa, Artificial Sequence
  Description of Artificial Sequence: Synthetic gluten peptide
ETRCIPGLERPWQQQPLPPQ

SEQ ID NO: 1058 - protein, 20 aa, Artificial Sequence
  Description of Artificial Sequence: Synthetic gluten peptide
METRCIPGLERPWQQQPLPP

SEQ ID NO: 1059 - protein, 20 aa, Artificial Sequence
  Description of Artificial Sequence: Synthetic gluten peptide
METSHIPSLEKPLQQQPLPL

SEQ ID NO: 1060 - protein, 20 aa, Artificial Sequence
  Description of Artificial Sequence: Synthetic gluten peptide
CASHIPSLEKPLQQQPLPLQ

SEQ ID NO: 1061 - protein, 20 aa, Artificial Sequence
  Description of Artificial Sequence: Synthetic gluten peptide
QQPFPQPQQAQLPFPQQPQQ

SEQ ID NO: 1062 - protein, 20 aa, Artificial Sequence
  Description of Artificial Sequence: Synthetic gluten peptide
PQQAQLPFPQQPQQPLPQPQ

SEQ ID NO: 1063 - protein, 20 aa, Artificial Sequence
  Description of Artificial Sequence: Synthetic gluten peptide
QAQLPFPQQPQQPLPQPQQP

SEQ ID NO: 1064 - protein, 20 aa, Artificial Sequence
  Description of Artificial Sequence: Synthetic gluten peptide
QQPFPQPQQAQLPFPQQPQQ

SEQ ID NO: 1065 - protein, 20 aa, Artificial Sequence
  Description of Artificial Sequence: Synthetic gluten peptide
QPFPQPQQAQLPFPQQPQQP

SEQ ID NO: 1066 - protein, 20 aa, Artificial Sequence
  Description of Artificial Sequence: Synthetic gluten peptide
QQPAQYEVIRSLVLRTLPNM

SEQ ID NO: 1067 - protein, 20 aa, Artificial Sequence
  Description of Artificial Sequence: Synthetic gluten peptide
QYEVIRSLVLRTLPNMCNVY

SEQ ID NO: 1068 - protein, 20 aa, Artificial Sequence
  Description of Artificial Sequence: Synthetic gluten peptide
QYEVIRSLVLRTLPNMCNVY

SEQ ID NO: 1069 - protein, 20 aa, Artificial Sequence
  Description of Artificial Sequence: Synthetic gluten peptide
QPQQPAQLEGIRSLVLKTLP

SEQ ID NO: 1070 - protein, 20 aa, Artificial Sequence
  Description of Artificial Sequence: Synthetic gluten peptide
IIQPQQPAQLEGIRSLVLKT

SEQ ID NO: 1071 - protein, 20 aa, Artificial Sequence
  Description of Artificial Sequence: Synthetic gluten peptide
QLAQGLGIIQPQQPAQLEGI

SEQ ID NO: 1072 - protein, 20 aa, Artificial Sequence
  Description of Artificial Sequence: Synthetic gluten peptide
QPQQPAQLEGIRSLVLKTLP

SEQ ID NO: 1073 - protein, 20 aa, Artificial Sequence
  Description of Artificial Sequence: Synthetic gluten peptide
IIQPQQPAQLEGIRSLVLKT

SEQ ID NO: 1074 - protein, 20 aa, Artificial Sequence
  Description of Artificial Sequence: Synthetic gluten peptide
CKVFLQQQCSPVAMPQRLAR

SEQ ID NO: 1075 - protein, 16 aa, Artificial Sequence
  Description of Artificial Sequence: Synthetic gluten peptide
LQQQCSPVAMPQRLAR

SEQ ID NO: 1076 - protein, 20 aa, Artificial Sequence
  Description of Artificial Sequence: Synthetic gluten peptide
VFLQQCSPVAMPQRLARSQM

SEQ ID NO: 1077 - protein, 20 aa, Artificial Sequence
  Description of Artificial Sequence: Synthetic gluten peptide
QQQCSPVAMPQRLARSQMWQ

SEQ ID NO: 1078 - protein, 20 aa, Artificial Sequence
  Description of Artificial Sequence: Synthetic gluten peptide
CSPVAMPQRLARSQMWQQSS

SEQ ID NO: 1079 - protein, 20 aa, Artificial Sequence
  Description of Artificial Sequence: Synthetic gluten peptide
QCSPVAMPQHLARSQMWQQS

SEQ ID NO: 1080 - protein, 20 aa, Artificial Sequence
  Description of Artificial Sequence: Synthetic gluten peptide
CKVFLQQQCSPVAMPQRLAR

SEQ ID NO: 1081 - protein, 20 aa, Artificial Sequence
  Description of Artificial Sequence: Synthetic gluten peptide
QQQCSPVAMPQRLARSQMWQ

SEQ ID NO: 1082 - protein, 20 aa, Artificial Sequence
  Description of Artificial Sequence: Synthetic gluten peptide
VFLQQQCSPVAMPQHLARSQ

SEQ ID NO: 1083 - protein, 20 aa, Artificial Sequence
  Description of Artificial Sequence: Synthetic gluten peptide
VFLQQQCSPVAMPQRLARSQ

SEQ ID NO: 1084 - protein, 20 aa, Artificial Sequence
  Description of Artificial Sequence: Synthetic gluten peptide
SPVAMPQRLARSQMLQQSSC

SEQ ID NO: 1085 - protein, 20 aa, Artificial Sequence
  Description of Artificial Sequence: Synthetic gluten peptide
QQLNPCKNFLLQQCKPVSLV

SEQ ID NO: 1086 - protein, 20 aa, Artificial Sequence
  Description of Artificial Sequence: Synthetic gluten peptide
SLIQQSLQQQLNPCKNFLLQ

SEQ ID NO: 1087 - protein, 20 aa, Artificial Sequence
  Description of Artificial Sequence: Synthetic gluten peptide
QPSLQQQVNPCKNFLLQQCK

SEQ ID NO: 1088 - protein, 20 aa, Artificial Sequence
  Description of Artificial Sequence: Synthetic gluten peptide
IQQSLQQQLNPCKNFLLQQC

SEQ ID NO: 1089 - protein, 20 aa, Artificial Sequence
  Description of Artificial Sequence: Synthetic gluten peptide
IQPSLQQQVNPCKNFLLQQC

SEQ ID NO: 1090 - protein, 20 aa, Artificial Sequence
  Description of Artificial Sequence: Synthetic gluten peptide
LQQQVNPCKNFLLQQCKLVS

SEQ ID NO: 1091 - protein, 20 aa, Artificial Sequence
  Description of Artificial Sequence: Synthetic gluten peptide
QGTFLQPQQVAQLELMTSIA

SEQ ID NO: 1092 - protein, 20 aa, Artificial Sequence
  Description of Artificial Sequence: Synthetic gluten peptide
QQPQFSQQQQIPVIHPSVLQ

SEQ ID NO: 1093 - protein, 20 aa, Artificial Sequence
  Description of Artificial Sequence: Synthetic gluten peptide
QPPFSQQQQPQFSQQQQIPV

SEQ ID NO: 1094 - protein, 20 aa, Artificial Sequence
  Description of Artificial Sequence: Synthetic gluten peptide
LQLQPFPQPQPFPPQLPYPQ

SEQ ID NO: 1095 - protein, 20 aa, Artificial Sequence
  Description of Artificial Sequence: Synthetic gluten peptide
QPFPSQQPYPQPQPFPPQLP

SEQ ID NO: 1096 - protein, 20 aa, Artificial Sequence
  Description of Artificial Sequence: Synthetic gluten peptide
PYPQPQPFPQPQPFPPQLPY

SEQ ID NO: 1097 - protein, 20 aa, Artificial Sequence
  Description of Artificial Sequence: Synthetic gluten peptide
LQLQPFPQPQPFPPQLPYPQ

SEQ ID NO: 1098 - protein, 20 aa, Artificial Sequence
  Description of Artificial Sequence: Synthetic gluten peptide
MQLQPFPQPQPFPPQLPYPQ

SEQ ID NO: 1099 - protein, 20 aa, Artificial Sequence
  Description of Artificial Sequence: Synthetic gluten peptide
QQPFPSQQPYPQPQPFPPQL

SEQ ID NO: 1100 - protein, 20 aa, Artificial Sequence
  Description of Artificial Sequence: Synthetic gluten peptide
PFPQPQPFPPQLPYPQPPPF

SEQ ID NO: 1101 - protein, 20 aa, Artificial Sequence
  Description of Artificial Sequence: Synthetic gluten peptide
PFPQPQPFPPQLPYPQPQSF

SEQ ID NO: 1102 - protein, 20 aa, Artificial Sequence
  Description of Artificial Sequence: Synthetic gluten peptide
PQPQPFPQPQPFPPQLPYPQ

SEQ ID NO: 1103 - protein, 20 aa, Artificial Sequence
  Description of Artificial Sequence: Synthetic gluten peptide
SQQPYLQLQPFPQPQPFPPQ

SEQ ID NO: 1104 - protein, 20 aa, Artificial Sequence
  Description of Artificial Sequence: Synthetic gluten peptide
PFPSQQPYPQPQPFPPQLPY

SEQ ID NO: 1105 - protein, 16 aa, Artificial Sequence
  Description of Artificial Sequence: Synthetic gluten peptide
GQQPFPQPEQPFCQQG

SEQ ID NO: 1106 - protein, 20 aa, Artificial Sequence
  Description of Artificial Sequence: Synthetic gluten peptide
GQVQWPQQQPFPQPQQPFCE

SEQ ID NO: 1107 - protein, 20 aa, Artificial Sequence
  Description of Artificial Sequence: Synthetic gluten peptide
WPQQQPFPQPQQPFCQQPQQ

SEQ ID NO: 1108 - protein, 16 aa, Artificial Sequence
  Description of Artificial Sequence: Synthetic gluten peptide
GQQPFPQPQQPFCQQG

SEQ ID NO: 1109 - protein, 20 aa, Artificial Sequence
  Description of Artificial Sequence: Synthetic gluten peptide
PQQQPFPQPQQPFCEQPQRT

SEQ ID NO: 1110 - protein, 20 aa, Artificial Sequence
  Description of Artificial Sequence: Synthetic gluten peptide
QQQPFPQPQQPFCQQPQRTI

SEQ ID NO: 1111 - protein, 20 aa, Artificial Sequence
  Description of Artificial Sequence: Synthetic gluten peptide
FPQPQQPFCQQPQRTIPQPH

SEQ ID NO: 1112 - protein, 20 aa, Artificial Sequence
  Description of Artificial Sequence: Synthetic gluten peptide
QQQPFPQPQQPFCEQPQRTI

SEQ ID NO: 1113 - protein, 20 aa, Artificial Sequence
  Description of Artificial Sequence: Synthetic gluten peptide
CCQQLPQIPEQSRYEAIRAI

SEQ ID NO: 1114 - protein, 20 aa, Artificial Sequence
  Description of Artificial Sequence: Synthetic gluten peptide
SSCHVMQQQCCQQLPQIPQQ

SEQ ID NO: 1115 - protein, 20 aa, Artificial Sequence
  Description of Artificial Sequence: Synthetic gluten peptide
QCCQQLPQIPQQSRYQAIRA

SEQ ID NO: 1116 - protein, 20 aa, Artificial Sequence
  Description of Artificial Sequence: Synthetic gluten peptide
QQCCQQLPQIPQQSRYEAIR

SEQ ID NO: 1117 - protein, 20 aa, Artificial Sequence
  Description of Artificial Sequence: Synthetic gluten peptide
QCCQQLPQIPEQSRSEAIRA

SEQ ID NO: 1118 - protein, 20 aa, Artificial Sequence
  Description of Artificial Sequence: Synthetic gluten peptide
QCCQQLPQIPQQSRYQAIRA

SEQ ID NO: 1119 - protein, 20 aa, Artificial Sequence
  Description of Artificial Sequence: Synthetic gluten peptide
HVMQQQCCQQLPQIPQQSRY

SEQ ID NO: 1120 - protein, 20 aa, Artificial Sequence
  Description of Artificial Sequence: Synthetic gluten peptide
QQCCQQLPQIPEQSRYDAIR

SEQ ID NO: 1121 - protein, 20 aa, Artificial Sequence
  Description of Artificial Sequence: Synthetic gluten peptide
QCCQQLPQIPEQSRYDVIRA

SEQ ID NO: 1122 - protein, 20 aa, Artificial Sequence
  Description of Artificial Sequence: Synthetic gluten peptide
CQQLPQIPQQSRYEAIRAII

SEQ ID NO: 1123 - protein, 20 aa, Artificial Sequence
  Description of Artificial Sequence: Synthetic gluten peptide
FPQPQLPFPQQSEQIIPQQL

SEQ ID NO: 1124 - protein, 20 aa, Artificial Sequence
  Description of Artificial Sequence: Synthetic gluten peptide
PQQSEQIIPQQLQQPFPLQP

SEQ ID NO: 1125 - protein, 20 aa, Artificial Sequence
  Description of Artificial Sequence: Synthetic gluten peptide
PQQSEQIIPQQLQQPFPLQP

SEQ ID NO: 1126 - protein, 20 aa, Artificial Sequence
  Description of Artificial Sequence: Synthetic gluten peptide
FPQPQLPFPQQSEQIIPQQL

SEQ ID NO: 1127 - protein, 20 aa, Artificial Sequence
  Description of Artificial Sequence: Synthetic gluten peptide
PLNNNNSPNNNSPSNHHNNS

SEQ ID NO: 1128 - protein, 20 aa, Artificial Sequence
  Description of Artificial Sequence: Synthetic gluten peptide
NNSPNNNSPSNHHNNSPNNN

SEQ ID NO: 1129 - protein, 20 aa, Artificial Sequence
  Description of Artificial Sequence: Synthetic gluten peptide
PLNNNNSPNNNSPSNHHNNS

SEQ ID NO: 1130 - protein, 20 aa, Artificial Sequence
  Description of Artificial Sequence: Synthetic gluten peptide
NNNSPNNNSPSNHHNNSPNN

SEQ ID NO: 1131 - protein, 20 aa, Artificial Sequence
  Description of Artificial Sequence: Synthetic gluten peptide
NNSPNNNSPSNHHNNSPNNN

SEQ ID NO: 1132 - protein, 16 aa, Artificial Sequence
  Description of Artificial Sequence: Synthetic gluten peptide
IIMQQEQQEQRQGVQI

SEQ ID NO: 1133 - protein, 20 aa, Artificial Sequence
  Description of Artificial Sequence: Synthetic gluten peptide
IVHSIIMQQEQQEQRQGVQI

SEQ ID NO: 1134 - protein, 16 aa, Artificial Sequence
  Description of Artificial Sequence: Synthetic gluten peptide
IVHSIIMQQEQQEQRQ

SEQ ID NO: 1135 - protein, 20 aa, Artificial Sequence
  Description of Artificial Sequence: Synthetic gluten peptide
SIVHSIIMQQEQQEQRQGVQ

SEQ ID NO: 1136 - protein, 20 aa, Artificial Sequence
  Description of Artificial Sequence: Synthetic gluten peptide
IVHSIIMQQEQQEQRQGVQI

SEQ ID NO: 1137 - protein, 20 aa, Artificial Sequence
  Description of Artificial Sequence: Synthetic gluten peptide
QQMNPCKNFLLQQCNHVSLV

SEQ ID NO: 1138 - protein, 20 aa, Artificial Sequence
  Description of Artificial Sequence: Synthetic gluten peptide
IQSFLQQQMNPCKNFLLQQC

SEQ ID NO: 1139 - protein, 20 aa, Artificial Sequence
  Description of Artificial Sequence: Synthetic gluten peptide
QSFLQQQMNPCKNFLLQQCN

SEQ ID NO: 1140 - protein, 20 aa, Artificial Sequence
  Description of Artificial Sequence: Synthetic gluten peptide
IQPYLQQQMNPCKNYLLQQC

SEQ ID NO: 1141 - protein, 20 aa, Artificial Sequence
  Description of Artificial Sequence: Synthetic gluten peptide
IQPYLQQQMNPCKNYLLQQC

SEQ ID NO: 1142 - protein, 20 aa, Artificial Sequence
  Description of Artificial Sequence: Synthetic gluten peptide
LQQQMNPCKNYLLQQCNPVS

SEQ ID NO: 1143 - protein, 20 aa, Artificial Sequence
  Description of Artificial Sequence: Synthetic gluten peptide
TMCNVNVPLYRTTTRVPFGV

SEQ ID NO: 1144 - protein, 20 aa, Artificial Sequence
  Description of Artificial Sequence: Synthetic gluten peptide
TSFALRTLPTMCNVNVPLYR

SEQ ID NO: 1145 - protein, 20 aa, Artificial Sequence
  Description of Artificial Sequence: Synthetic gluten peptide
CNHVSLVSSLVSIILPRSDC

SEQ ID NO: 1146 - protein, 20 aa, Artificial Sequence
  Description of Artificial Sequence: Synthetic gluten peptide
HVSLVSSLVSIILPRSDCQV

SEQ ID NO: 1147 - protein, 20 aa, Artificial Sequence
  Description of Artificial Sequence: Synthetic gluten peptide
LVSSLVSIILPRSDCQVMQQ

SEQ ID NO: 1148 - protein, 20 aa, Artificial Sequence
  Description of Artificial Sequence: Synthetic gluten peptide
SCHVMQQQCCQQLAQIPEQS

SEQ ID NO: 1149 - protein, 20 aa, Artificial Sequence
  Description of Artificial Sequence: Synthetic gluten peptide
QCCQQLAQIPEQSRHEAIRA

SEQ ID NO: 1150 - protein, 20 aa, Artificial Sequence
  Description of Artificial Sequence: Synthetic gluten peptide
MESNIIISFLKPWLQQPLPP

SEQ ID NO: 1151 - protein, 20 aa, Artificial Sequence
  Description of Artificial Sequence: Synthetic gluten peptide
SNIIISFLKPWLQQPLPPQQ

SEQ ID NO: 1152 - protein, 20 aa, Artificial Sequence
  Description of Artificial Sequence: Synthetic gluten peptide
QQPFPQPQQPQLPFPQQPQQ

SEQ ID NO: 1153 - protein, 20 aa, Artificial Sequence
  Description of Artificial Sequence: Synthetic gluten peptide
PQQPFPQPQQPQQPFPQPQQ

SEQ ID NO: 1154 - protein, 20 aa, Artificial Sequence
  Description of Artificial Sequence: Synthetic gluten peptide
QLPFPQQPQQPFPQPQQPQQ

SEQ ID NO: 1155 - protein, 20 aa, Artificial Sequence
  Description of Artificial Sequence: Synthetic gluten peptide
QPQQPQQPFPQPQQPQLPFP

SEQ ID NO: 1156 - protein, 20 aa, Artificial Sequence
  Description of Artificial Sequence: Synthetic gluten peptide
QQPQQPFPQPQQPQLPFPQQ

SEQ ID NO: 1157 - protein, 20 aa, Artificial Sequence
  Description of Artificial Sequence: Synthetic gluten peptide
SQQPQQPFPQPQQPQQSFPQ

SEQ ID NO: 1158 - protein, 20 aa, Artificial Sequence
  Description of Artificial Sequence: Synthetic gluten peptide
QQQQPFPQPQQPQQPFPQPQ

SEQ ID NO: 1159 - protein, 20 aa, Artificial Sequence
  Description of Artificial Sequence: Synthetic gluten peptide
QQPQQPFPQPQQPQLPFPQQ

SEQ ID NO: 1160 - protein, 20 aa, Artificial Sequence
  Description of Artificial Sequence: Synthetic gluten peptide
PQQPFPQPQQPQLPFPQQPQ

SEQ ID NO: 1161 - protein, 20 aa, Artificial Sequence
  Description of Artificial Sequence: Synthetic gluten peptide
SKQPQQPFPQPQQPQQSFPQ

SEQ ID NO: 1162 - protein, 20 aa, Artificial Sequence
  Description of Artificial Sequence: Synthetic gluten peptide
QSKQPQQPFPQPQQPQQSFP

SEQ ID NO: 1163 - protein, 16 aa, Artificial Sequence
  Description of Artificial Sequence: Synthetic gluten peptide
GQQPFPQPEQPQLPFG

SEQ ID NO: 1164 - protein, 20 aa, Artificial Sequence
  Description of Artificial Sequence: Synthetic gluten peptide
QQPFPQPQQPQLPFPQQPQQ

SEQ ID NO: 1165 - protein, 16 aa, Artificial Sequence
  Description of Artificial Sequence: Synthetic gluten peptide
GQQPFPQPEQPQQPFG

SEQ ID NO: 1166 - protein, 16 aa, Artificial Sequence
  Description of Artificial Sequence: Synthetic gluten peptide
GQQPFPQPQQPQLPFG

SEQ ID NO: 1167 - protein, 20 aa, Artificial Sequence
  Description of Artificial Sequence: Synthetic gluten peptide
QQPFPQPQQPQQPFPQLQQP

SEQ ID NO: 1168 - protein, 16 aa, Artificial Sequence
  Description of Artificial Sequence: Synthetic gluten peptide
GQQPFPQPEQPQQSFG

SEQ ID NO: 1169 - protein, 20 aa, Artificial Sequence
  Description of Artificial Sequence: Synthetic gluten peptide
GQVQWPQQQQPFPQPQQPQQ

SEQ ID NO: 1170 - protein, 20 aa, Artificial Sequence
  Description of Artificial Sequence: Synthetic gluten peptide
PQQPFPQPQQPQQPFPQLQQ

SEQ ID NO: 1171 - protein, 16 aa, Artificial Sequence
  Description of Artificial Sequence: Synthetic gluten peptide
GQQPFPQPQQPQQPFG

SEQ ID NO: 1172 - protein, 16 aa, Artificial Sequence
  Description of Artificial Sequence: Synthetic gluten peptide
GQQPFPQPQQPQQSFG

SEQ ID NO: 1173 - protein, 20 aa, Artificial Sequence
  Description of Artificial Sequence: Synthetic gluten peptide
QQPFPQPQQPQQPFPQSQQP

SEQ ID NO: 1174 - protein, 20 aa, Artificial Sequence
  Description of Artificial Sequence: Synthetic gluten peptide
PFPQPQQPQQSFPQQQQPLI

SEQ ID NO: 1175 - protein, 20 aa, Artificial Sequence
  Description of Artificial Sequence: Synthetic gluten peptide
PQQPFPQPQQPQQPFPQPQQ

SEQ ID NO: 1176 - protein, 20 aa, Artificial Sequence
  Description of Artificial Sequence: Synthetic gluten peptide
QLPFPQQPQQPFPQPQQPQQ

SEQ ID NO: 1177 - protein, 20 aa, Artificial Sequence
  Description of Artificial Sequence: Synthetic gluten peptide
PQQQFPQPQQPQQPFPQQPQ

SEQ ID NO: 1178 - protein, 20 aa, Artificial Sequence
  Description of Artificial Sequence: Synthetic gluten peptide
QPFPQPQQQFPQPQQPQQSF

SEQ ID NO: 1179 - protein, 20 aa, Artificial Sequence
  Description of Artificial Sequence: Synthetic gluten peptide
SQQPQQPFPQPQQPQQSFPQ

SEQ ID NO: 1180 - protein, 20 aa, Artificial Sequence
  Description of Artificial Sequence: Synthetic gluten peptide
QQQQPFPQPQQPQQPFPQPQ

SEQ ID NO: 1181 - protein, 20 aa, Artificial Sequence
  Description of Artificial Sequence: Synthetic gluten peptide
SKQPQQPFPQPQQPQQSFPQ

SEQ ID NO: 1182 - protein, 20 aa, Artificial Sequence
  Description of Artificial Sequence: Synthetic gluten peptide
QQFPQPQQPQQQFLQPQQPF

SEQ ID NO: 1183 - protein, 20 aa, Artificial Sequence
  Description of Artificial Sequence: Synthetic gluten peptide
QSKQPQQPFPQPQQPQQSFP

SEQ ID NO: 1184 - protein, 20 aa, Artificial Sequence
  Description of Artificial Sequence: Synthetic gluten peptide
QQFPQPQQPQQPFPQQPQQQ

SEQ ID NO: 1185 - protein, 16 aa, Artificial Sequence
  Description of Artificial Sequence: Synthetic gluten peptide
GQQPFPQPEQPQQPFG

SEQ ID NO: 1186 - protein, 16 aa, Artificial Sequence
  Description of Artificial Sequence: Synthetic gluten peptide
GFPQPQQPEQSFPQQG

SEQ ID NO: 1187 - protein, 20 aa, Artificial Sequence
  Description of Artificial Sequence: Synthetic gluten peptide
QQPQQQFPQPQQPQQPFPQP

SEQ ID NO: 1188 - protein, 16 aa, Artificial Sequence
  Description of Artificial Sequence: Synthetic gluten peptide
GFPQPQQPEQPFPQQG

SEQ ID NO: 1189 - protein, 20 aa, Artificial Sequence
  Description of Artificial Sequence: Synthetic gluten peptide
PQPQQQFPQPQQPQQSFPQQ

SEQ ID NO: 1190 - protein, 16 aa, Artificial Sequence
  Description of Artificial Sequence: Synthetic gluten peptide
GQQQFPQPEQPQQSFG

SEQ ID NO: 1191 - protein, 16 aa, Artificial Sequence
  Description of Artificial Sequence: Synthetic gluten peptide
GFPQPQQPQQPFPQQG

SEQ ID NO: 1192 - protein, 20 aa, Artificial Sequence
  Description of Artificial Sequence: Synthetic gluten peptide
FPQPQQPQQQFLQPRQPFPQ

SEQ ID NO: 1193 - protein, 20 aa, Artificial Sequence
  Description of Artificial Sequence: Synthetic gluten peptide
QQPFPQPQQPQQPFPQLQQP

SEQ ID NO: 1194 - protein, 20 aa, Artificial Sequence
  Description of Artificial Sequence: Synthetic gluten peptide
PQQQFPQPQQPQQPFPQQPQ

SEQ ID NO: 1195 - protein, 16 aa, Artificial Sequence
  Description of Artificial Sequence: Synthetic gluten peptide
GQQPFPQPEQPQQSFG

SEQ ID NO: 1196 - protein, 20 aa, Artificial Sequence
  Description of Artificial Sequence: Synthetic gluten peptide
GQVQWPQQQQPFPQPQQPQQ

SEQ ID NO: 1197 - protein, 20 aa, Artificial Sequence
  Description of Artificial Sequence: Synthetic gluten peptide
PQQPFPQPQQPQQPFPQLQQ

SEQ ID NO: 1198 - protein, 16 aa, Artificial Sequence
  Description of Artificial Sequence: Synthetic gluten peptide
GQQPFPQPQQPQQPFG

SEQ ID NO: 1199 - protein, 16 aa, Artificial Sequence
  Description of Artificial Sequence: Synthetic gluten peptide
GQQPFPQPQQPQQSFG

SEQ ID NO: 1200 - protein, 20 aa, Artificial Sequence
  Description of Artificial Sequence: Synthetic gluten peptide
QQPFPQPQQPQQPFPQSQQP

SEQ ID NO: 1201 - protein, 16 aa, Artificial Sequence
  Description of Artificial Sequence: Synthetic gluten peptide
GFPQPQQPQQSFPQQG

SEQ ID NO: 1202 - protein, 20 aa, Artificial Sequence
  Description of Artificial Sequence: Synthetic gluten peptide
PFPQPQQPQQSFPQQQQPLI

SEQ ID NO: 1203 - protein, 16 aa, Artificial Sequence
  Description of Artificial Sequence: Synthetic gluten peptide
GQQQFPQPQQPQQSFG

SEQ ID NO: 1204 - protein, 16 aa, Artificial Sequence
  Description of Artificial Sequence: Synthetic gluten peptide
GQQQFPQPQQPQQPFG

SEQ ID NO: 1205 - protein, 20 aa, Artificial Sequence
  Description of Artificial Sequence: Synthetic gluten peptide
TFPHQPQQQFPQPQQPQQPF

SEQ ID NO: 1206 - protein, 20 aa, Artificial Sequence
  Description of Artificial Sequence: Synthetic gluten peptide
QTFPHQPQQQFPQPQQPQQQ

SEQ ID NO: 1207 - protein, 20 aa, Artificial Sequence
  Description of Artificial Sequence: Synthetic gluten peptide
SQPQQQFPQPQQPQQSFPQQ

SEQ ID NO: 1208 - protein, 20 aa, Artificial Sequence
  Description of Artificial Sequence: Synthetic gluten peptide
QTCPHQPQQQFPQPQQPQQP

SEQ ID NO: 1209 - protein, 16 aa, Artificial Sequence
  Description of Artificial Sequence: Synthetic gluten peptide
GQQQFPQPEQPQQPFG

SEQ ID NO: 1210 - protein, 20 aa, Artificial Sequence
  Description of Artificial Sequence: Synthetic gluten peptide
QQFPQPQQPQQQFLQPRQPF

SEQ ID NO: 1211 - protein, 20 aa, Artificial Sequence
  Description of Artificial Sequence: Synthetic gluten peptide
QQFPQPQQPQQQFLQPQQPF

SEQ ID NO: 1212 - protein, 20 aa, Artificial Sequence
  Description of Artificial Sequence: Synthetic gluten peptide
LQQSSYQQLQQLCCQQLFQI

SEQ ID NO: 1213 - protein, 20 aa, Artificial Sequence
  Description of Artificial Sequence: Synthetic gluten peptide
QSSYQQLQQLCCQQLFQIPE

SEQ ID NO: 1214 - protein, 20 aa, Artificial Sequence
  Description of Artificial Sequence: Synthetic gluten peptide
PQQSFPQQSQQSQQPFAQPQ

SEQ ID NO: 1215 - protein, 20 aa, Artificial Sequence
  Description of Artificial Sequence: Synthetic gluten peptide
PQPQQPIPVQPQQSFPQQSQ

SEQ ID NO: 1216 - protein, 20 aa, Artificial Sequence
  Description of Artificial Sequence: Synthetic gluten peptide
QPQQPIPVQPQQSFPQQSQQ

SEQ ID NO: 1217 - protein, 20 aa, Artificial Sequence
  Description of Artificial Sequence: Synthetic gluten peptide
VQPQQSFPQQSQQSQQPFAQ

SEQ ID NO: 1218 - protein, 20 aa, Artificial Sequence
  Description of Artificial Sequence: Synthetic gluten peptide
RPQQLYPQPQPQYSQPQQPI

SEQ ID NO: 1219 - protein, 20 aa, Artificial Sequence
  Description of Artificial Sequence: Synthetic gluten peptide
QPFRPQQLYPQPQPQYSQPQ

SEQ ID NO: 1220 - protein, 20 aa, Artificial Sequence
  Description of Artificial Sequence: Synthetic gluten peptide
QQPFPQQPQQPFPQPQQPIP

SEQ ID NO: 1221 - protein, 20 aa, Artificial Sequence
  Description of Artificial Sequence: Synthetic gluten peptide
QQFLQPQQPFPQQPQQPYPQ

SEQ ID NO: 1222 - protein, 20 aa, Artificial Sequence
  Description of Artificial Sequence: Synthetic gluten peptide
PLQPQQPFPQQPQQPFPQPQ

SEQ ID NO: 1223 - protein, 20 aa, Artificial Sequence
  Description of Artificial Sequence: Synthetic gluten peptide
PQQQFIQPQQPFPQQPQQTY

SEQ ID NO: 1224 - protein, 20 aa, Artificial Sequence
  Description of Artificial Sequence: Synthetic gluten peptide
PQQPFPQQPQQQFPQPQQPQ

SEQ ID NO: 1225 - protein, 20 aa, Artificial Sequence
  Description of Artificial Sequence: Synthetic gluten peptide
PQQQFPQPQQPQQPFPQQPQ

SEQ ID NO: 1226 - protein, 20 aa, Artificial Sequence
  Description of Artificial Sequence: Synthetic gluten peptide
TQQPQQPFPQQPQQPFPQTQ

SEQ ID NO: 1227 - protein, 20 aa, Artificial Sequence
  Description of Artificial Sequence: Synthetic gluten peptide
PQQPFPQQPQQPQQPFPQPQ

SEQ ID NO: 1228 - protein, 20 aa, Artificial Sequence
  Description of Artificial Sequence: Synthetic gluten peptide
QQPFPQTQQPQQPFPQQPQQ

SEQ ID NO: 1229 - protein, 20 aa, Artificial Sequence
  Description of Artificial Sequence: Synthetic gluten peptide
QTQQPQQPFPQQPQQPFPQT

SEQ ID NO: 1230 - protein, 20 aa, Artificial Sequence
  Description of Artificial Sequence: Synthetic gluten peptide
QQPQQPFPQQPQQQFPQPQQ

SEQ ID NO: 1231 - protein, 20 aa, Artificial Sequence
  Description of Artificial Sequence: Synthetic gluten peptide
QQPFPQQPQQPFPQTQQPQQ

SEQ ID NO: 1232 - protein, 20 aa, Artificial Sequence
  Description of Artificial Sequence: Synthetic gluten peptide
TPIQPQQPFPQQPQQPQQPF

SEQ ID NO: 1233 - protein, 20 aa, Artificial Sequence
  Description of Artificial Sequence: Synthetic gluten peptide
QQPYPQQPQQPFPQTQQPQQ

SEQ ID NO: 1234 - protein, 20 aa, Artificial Sequence
  Description of Artificial Sequence: Synthetic gluten peptide
QQQFIQPQQPFPQQPQQTYP

SEQ ID NO: 1235 - protein, 20 aa, Artificial Sequence
  Description of Artificial Sequence: Synthetic gluten peptide
PIQPQQPFPQQPQQPQQPFP

SEQ ID NO: 1236 - protein, 20 aa, Artificial Sequence
  Description of Artificial Sequence: Synthetic gluten peptide
PQQQFIQPQQPFPQQPQQTY

SEQ ID NO: 1237 - protein, 20 aa, Artificial Sequence
  Description of Artificial Sequence: Synthetic gluten peptide
QQFPQPQQPQQPFPQQPQQQ

SEQ ID NO: 1238 - protein, 20 aa, Artificial Sequence
  Description of Artificial Sequence: Synthetic gluten peptide
FPLQPQQPFPQQPQQPFPQP

SEQ ID NO: 1239 - protein, 20 aa, Artificial Sequence
  Description of Artificial Sequence: Synthetic gluten peptide
PQQPFLQPQQPFPQQPQQPF

SEQ ID NO: 1240 - protein, 20 aa, Artificial Sequence
  Description of Artificial Sequence: Synthetic gluten peptide
PLQPQQPFPQQPQQPFPQQP

SEQ ID NO: 1241 - protein, 16 aa, Artificial Sequence
  Description of Artificial Sequence: Synthetic gluten peptide
GQPQQPFPEQPQQPFG

SEQ ID NO: 1242 - protein, 20 aa, Artificial Sequence
  Description of Artificial Sequence: Synthetic gluten peptide
YPQQPFPQQPQQPFPQQPPF

SEQ ID NO: 1243 - protein, 20 aa, Artificial Sequence
  Description of Artificial Sequence: Synthetic gluten peptide
PQQPQQPFPQQPQQSFPQQP

SEQ ID NO: 1244 - protein, 20 aa, Artificial Sequence
  Description of Artificial Sequence: Synthetic gluten peptide
PQQPFPQQPQQQFPQPQQPQ

SEQ ID NO: 1245 - protein, 20 aa, Artificial Sequence
  Description of Artificial Sequence: Synthetic gluten peptide
QQPFPQQPQQPSSQQPPFPQ

SEQ ID NO: 1246 - protein, 20 aa, Artificial Sequence
  Description of Artificial Sequence: Synthetic gluten peptide
PQQQFLQPQQPFPQQPQQPY

SEQ ID NO: 1247 - protein, 20 aa, Artificial Sequence
  Description of Artificial Sequence: Synthetic gluten peptide
PLQPQQPFPQQPQQPFPQPQ

SEQ ID NO: 1248 - protein, 20 aa, Artificial Sequence
  Description of Artificial Sequence: Synthetic gluten peptide
PQQQFPQPQQPQQPFPQQPQ

SEQ ID NO: 1249 - protein, 16 aa, Artificial Sequence
  Description of Artificial Sequence: Synthetic gluten peptide
GQPQQPFPQQPQQPFG

SEQ ID NO: 1250 - protein, 20 aa, Artificial Sequence
  Description of Artificial Sequence: Synthetic gluten peptide
RQPFPQQPQQPYPQQPQQPF

SEQ ID NO: 1251 - protein, 16 aa, Artificial Sequence
  Description of Artificial Sequence: Synthetic gluten peptide
GQPQQPFPEQPQQSFG

SEQ ID NO: 1252 - protein, 16 aa, Artificial Sequence
  Description of Artificial Sequence: Synthetic gluten peptide
GQPQQPFPQQPQQSFG

SEQ ID NO: 1253 - protein, 20 aa, Artificial Sequence
  Description of Artificial Sequence: Synthetic gluten peptide
PQQPFPQQPQQSFPQQPQQP

SEQ ID NO: 1254 - protein, 20 aa, Artificial Sequence
  Description of Artificial Sequence: Synthetic gluten peptide
QQPFPQQPQQPYPQQPQQPF

SEQ ID NO: 1255 - protein, 20 aa, Artificial Sequence
  Description of Artificial Sequence: Synthetic gluten peptide
QPQQPFPQQPQQPFPQTQQP

SEQ ID NO: 1256 - protein, 20 aa, Artificial Sequence
  Description of Artificial Sequence: Synthetic gluten peptide
QQPFPQTQQPQQPFPQQPQQ

SEQ ID NO: 1257 - protein, 20 aa, Artificial Sequence
  Description of Artificial Sequence: Synthetic gluten peptide
FPQQPQQPYPQQPQQPFPQT

SEQ ID NO: 1258 - protein, 20 aa, Artificial Sequence
  Description of Artificial Sequence: Synthetic gluten peptide
PQQPFPQQPQQTYPQRPQQP

SEQ ID NO: 1259 - protein, 20 aa, Artificial Sequence
  Description of Artificial Sequence: Synthetic gluten peptide
QQPQQPFPQQPQQQFPQPQQ

SEQ ID NO: 1260 - protein, 15 aa, Artificial Sequence
  Description of Artificial Sequence: Synthetic gluten peptide
PFPEQPEQPYPQQPQ

SEQ ID NO: 1261 - protein, 16 aa, Artificial Sequence
  Description of Artificial Sequence: Synthetic gluten peptide
GQPQQPFPEQPQQTFG

SEQ ID NO: 1262 - protein, 20 aa, Artificial Sequence
  Description of Artificial Sequence: Synthetic gluten peptide
PFPQQPQQPFPQQPQQSFPQ

SEQ ID NO: 1263 - protein, 16 aa, Artificial Sequence
  Description of Artificial Sequence: Synthetic gluten peptide
GQPQQPFPQQPQQTFG

SEQ ID NO: 1264 - protein, 20 aa, Artificial Sequence
  Description of Artificial Sequence: Synthetic gluten peptide
YAQPYLPYPQQPFPQQPQQP

SEQ ID NO: 1265 - protein, 20 aa, Artificial Sequence
  Description of Artificial Sequence: Synthetic gluten peptide
PQQPQQPFPQQPQQQFPQPQ

SEQ ID NO: 1266 - protein, 16 aa, Artificial Sequence
  Description of Artificial Sequence: Synthetic gluten peptide
GQPQQPFPEQPQQQFG

SEQ ID NO: 1267 - protein, 20 aa, Artificial Sequence
  Description of Artificial Sequence: Synthetic gluten peptide
PQQPQQPYPQQPQQLFPQTQ

SEQ ID NO: 1268 - protein, 16 aa, Artificial Sequence
  Description of Artificial Sequence: Synthetic gluten peptide
GQPQQPFPQQPQQQFG

SEQ ID NO: 1269 - protein, 20 aa, Artificial Sequence
  Description of Artificial Sequence: Synthetic gluten peptide
QQPFPQQPQQTYPQRPQQPF

SEQ ID NO: 1270 - protein, 20 aa, Artificial Sequence
  Description of Artificial Sequence: Synthetic gluten peptide
QQPFPQQPQQTYPQRPQQPF

SEQ ID NO: 1271 - protein, 20 aa, Artificial Sequence
  Description of Artificial Sequence: Synthetic gluten peptide
LQPQQPFPQQPQQPYPQQPQ

SEQ ID NO: 1272 - protein, 20 aa, Artificial Sequence
  Description of Artificial Sequence: Synthetic gluten peptide
PRQPFPQQPQQPYPQQPQQP

SEQ ID NO: 1273 - protein, 20 aa, Artificial Sequence
  Description of Artificial Sequence: Synthetic gluten peptide
QGTFLQPQQVAQLELMTSIA

SEQ ID NO: 1274 - protein, 20 aa, Artificial Sequence
  Description of Artificial Sequence: Synthetic gluten peptide
QPQQQQLAHQIAQLEVMTSI

SEQ ID NO: 1275 - protein, 20 aa, Artificial Sequence
  Description of Artificial Sequence: Synthetic gluten peptide
QPHQIAQLEVMTSIALRILP

SEQ ID NO: 1276 - protein, 20 aa, Artificial Sequence
  Description of Artificial Sequence: Synthetic gluten peptide
PHQIAQLEVMTSFALRTLPT

SEQ ID NO: 1277 - protein, 20 aa, Artificial Sequence
  Description of Artificial Sequence: Synthetic gluten peptide
HQIAQLEVMTSIALRILPTM

SEQ ID NO: 1278 - protein, 20 aa, Artificial Sequence
  Description of Artificial Sequence: Synthetic gluten peptide
GTLLQPHQIAQLEVMTSIAL

SEQ ID NO: 1279 - protein, 20 aa, Artificial Sequence
  Description of Artificial Sequence: Synthetic gluten peptide
QIAQLEVMTSFALRTLPTMC

SEQ ID NO: 1280 - protein, 20 aa, Artificial Sequence
  Description of Artificial Sequence: Synthetic gluten peptide
TLLQPHQIAQLELMTSIALR

SEQ ID NO: 1281 - protein, 20 aa, Artificial Sequence
  Description of Artificial Sequence: Synthetic gluten peptide
FLQPHQIAQLEVMTSIAPRT

SEQ ID NO: 1282 - protein, 20 aa, Artificial Sequence
  Description of Artificial Sequence: Synthetic gluten peptide
QGTFLQPHQIAQLEVMTSIA

SEQ ID NO: 1283 - protein, 20 aa, Artificial Sequence
  Description of Artificial Sequence: Synthetic gluten peptide
QIAQLEVMTSIALRILPTMC

SEQ ID NO: 1284 - protein, 20 aa, Artificial Sequence
  Description of Artificial Sequence: Synthetic gluten peptide
ELCCQHLWQIPEQSQCQAIH

SEQ ID NO: 1285 - protein, 20 aa, Artificial Sequence
  Description of Artificial Sequence: Synthetic gluten peptide
HLWQIPEQSQCQAIQNVVHA

SEQ ID NO: 1286 - protein, 20 aa, Artificial Sequence
  Description of Artificial Sequence: Synthetic gluten peptide
QHLWQIPEQSQCQAIHKVVH

SEQ ID NO: 1287 - protein, 20 aa, Artificial Sequence
  Description of Artificial Sequence: Synthetic gluten peptide
ELCCQHLWQIPEQSQCQAIH

SEQ ID NO: 1288 - protein, 20 aa, Artificial Sequence
  Description of Artificial Sequence: Synthetic gluten peptide
QSGQGLSQSQQQSQQQLGQC

SEQ ID NO: 1289 - protein, 20 aa, Artificial Sequence
  Description of Artificial Sequence: Synthetic gluten peptide
QSDQGVSQSQQQSQQQLGQC

SEQ ID NO: 1290 - protein, 20 aa, Artificial Sequence
  Description of Artificial Sequence: Synthetic gluten peptide
QGVSQSQQQSQQQLGQCSFQ

SEQ ID NO: 1291 - protein, 20 aa, Artificial Sequence
  Description of Artificial Sequence: Synthetic gluten peptide
FILSVSQPQQQQSQQQLGQQ

SEQ ID NO: 1292 - protein, 20 aa, Artificial Sequence
  Description of Artificial Sequence: Synthetic gluten peptide
QCVSQPQQQSQQQLGQQPQQ

SEQ ID NO: 1293 - protein, 20 aa, Artificial Sequence
  Description of Artificial Sequence: Synthetic gluten peptide
QQSGQGVSQSQQQSQQQLGQ

SEQ ID NO: 1294 - protein, 20 aa, Artificial Sequence
  Description of Artificial Sequence: Synthetic gluten peptide
CVSQPQQQSQQQLGQQPQQQ

SEQ ID NO: 1295 - protein, 20 aa, Artificial Sequence
  Description of Artificial Sequence: Synthetic gluten peptide
YQPQQQSQQQLGQCSFQQPQ

SEQ ID NO: 1296 - protein, 20 aa, Artificial Sequence
  Description of Artificial Sequence: Synthetic gluten peptide
QSQQQSQQQLGQCSFQQPQQ

SEQ ID NO: 1297 - protein, 20 aa, Artificial Sequence
  Description of Artificial Sequence: Synthetic gluten peptide
QPQQQQSQQQLGQQPQQQQQ

SEQ ID NO: 1298 - protein, 20 aa, Artificial Sequence
  Description of Artificial Sequence: Synthetic gluten peptide
QLGQCVSQPQQQSQQQLGQQ

SEQ ID NO: 1299 - protein, 20 aa, Artificial Sequence
  Description of Artificial Sequence: Synthetic gluten peptide
QLGQCVSQPQQQSQQQLGQQ

SEQ ID NO: 1300 - protein, 20 aa, Artificial Sequence
  Description of Artificial Sequence: Synthetic gluten peptide
ISIVQPSILQQLNPCKVFLQ

SEQ ID NO: 1301 - protein, 20 aa, Artificial Sequence
  Description of Artificial Sequence: Synthetic gluten peptide
PQQQISIVQPSVLQQLNPCK

SEQ ID NO: 1302 - protein, 20 aa, Artificial Sequence
  Description of Artificial Sequence: Synthetic gluten peptide
QQQLPQQQISIVQPSILQQL

SEQ ID NO: 1303 - protein, 20 aa, Artificial Sequence
  Description of Artificial Sequence: Synthetic gluten peptide
PLYSATTSVRFGVGTGVGAY

SEQ ID NO: 1304 - protein, 20 aa, Artificial Sequence
  Description of Artificial Sequence: Synthetic gluten peptide
VPLYSATTSVRFGVGTGVGA

SEQ ID NO: 1305 - protein, 20 aa, Artificial Sequence
  Description of Artificial Sequence: Synthetic gluten peptide
AIIMHQQEQQQQLQQQQQQQ

SEQ ID NO: 1306 - protein, 16 aa, Artificial Sequence
  Description of Artificial Sequence: Synthetic gluten peptide
GQMHQQEQQQQLQQQG

SEQ ID NO: 1307 - protein, 20 aa, Artificial Sequence
  Description of Artificial Sequence: Synthetic gluten peptide
HQQEQQQQLQQQQQQQLQQQ

SEQ ID NO: 1308 - protein, 20 aa, Artificial Sequence
  Description of Artificial Sequence: Synthetic gluten peptide
IIMHQQEQQQQLQQQQQQQL

SEQ ID NO: 1309 - protein, 16 aa, Artificial Sequence
  Description of Artificial Sequence: Synthetic gluten peptide
GQMHQQEQEQQLQQQG

SEQ ID NO: 1310 - protein, 20 aa, Artificial Sequence
  Description of Artificial Sequence: Synthetic gluten peptide
LQQILQQQLTPCMDVVLQQH

SEQ ID NO: 1311 - protein, 20 aa, Artificial Sequence
  Description of Artificial Sequence: Synthetic gluten peptide
QQQQEQQILQQILQQQLTPC

SEQ ID NO: 1312 - protein, 20 aa, Artificial Sequence
  Description of Artificial Sequence: Synthetic gluten peptide
ILQQILQQQLTPCMDVVLQQ

SEQ ID NO: 1313 - protein, 20 aa, Artificial Sequence
  Description of Artificial Sequence: Synthetic gluten peptide
QQVLPQQQIPFVHPSILQQL

SEQ ID NO: 1314 - protein, 20 aa, Artificial Sequence
  Description of Artificial Sequence: Synthetic gluten peptide
QLPPFSQQQQQVLPQQQIPF

SEQ ID NO: 1315 - protein, 20 aa, Artificial Sequence
  Description of Artificial Sequence: Synthetic gluten peptide
FSQQQQPQFSQQQQPFPQQQ

SEQ ID NO: 1316 - protein, 20 aa, Artificial Sequence
  Description of Artificial Sequence: Synthetic gluten peptide
FSQQQQPQFSQQQQPFPQQQ

SEQ ID NO: 1317 - protein, 20 aa, Artificial Sequence
  Description of Artificial Sequence: Synthetic gluten peptide
PPFSQQQQPQFSQQQQPFPQ

SEQ ID NO: 1318 - protein, 20 aa, Artificial Sequence
  Description of Artificial Sequence: Synthetic gluten peptide
METSCIPGLERPWQQQPLQQ

SEQ ID NO: 1319 - protein, 20 aa, Artificial Sequence
  Description of Artificial Sequence: Synthetic gluten peptide
ETRCIPGLERPWQQQPLPPQ

SEQ ID NO: 1320 - protein, 20 aa, Artificial Sequence
  Description of Artificial Sequence: Synthetic gluten peptide
MRCIPGLERPWQQQPLPPQQ

SEQ ID NO: 1321 - protein, 20 aa, Artificial Sequence
  Description of Artificial Sequence: Synthetic gluten peptide
METRCIPGLERPWQQQPLPP

SEQ ID NO: 1322 - protein, 20 aa, Artificial Sequence
  Description of Artificial Sequence: Synthetic gluten peptide
MDTSCIPGLERPWQQQPLPP

SEQ ID NO: 1323 - protein, 20 aa, Artificial Sequence
  Description of Artificial Sequence: Synthetic gluten peptide
ETSCIPGLERPWQEQPLPPQ

SEQ ID NO: 1324 - protein, 20 aa, Artificial Sequence
  Description of Artificial Sequence: Synthetic gluten peptide
MVFLQQQCIPVAMQRCLARS

SEQ ID NO: 1325 - protein, 20 aa, Artificial Sequence
  Description of Artificial Sequence: Synthetic gluten peptide
LNPCKVFLQQQCIPVAMQRC

SEQ ID NO: 1326 - protein, 20 aa, Artificial Sequence
  Description of Artificial Sequence: Synthetic gluten peptide
VMQQQCCQQLAQIPRQLQCA

SEQ ID NO: 1327 - protein, 20 aa, Artificial Sequence
  Description of Artificial Sequence: Synthetic gluten peptide
QCCQQLAQIPRQLQCAAIHS

SEQ ID NO: 1328 - protein, 20 aa, Artificial Sequence
  Description of Artificial Sequence: Synthetic gluten peptide
MQQQCCQQLAQIPRQLQCAA

SEQ ID NO: 1329 - protein, 20 aa, Artificial Sequence
  Description of Artificial Sequence: Synthetic gluten peptide
QLAQIPRQLQCAAIHSVVHS

SEQ ID NO: 1330 - protein, 20 aa, Artificial Sequence
  Description of Artificial Sequence: Synthetic gluten peptide
HHQQQPIQQQPHQFPQQQPC

SEQ ID NO: 1331 - protein, 20 aa, Artificial Sequence
  Description of Artificial Sequence: Synthetic gluten peptide
YPQQRPMYLQPQQPISQQQA

SEQ ID NO: 1332 - protein, 20 aa, Artificial Sequence
  Description of Artificial Sequence: Synthetic gluten peptide
SFPPQQPYPQQRPMYLQPQQ

SEQ ID NO: 1333 - protein, 20 aa, Artificial Sequence
  Description of Artificial Sequence: Synthetic gluten peptide
YPQQRPMYLQPQQPISQQQA

SEQ ID NO: 1334 - protein, 20 aa, Artificial Sequence
  Description of Artificial Sequence: Synthetic gluten peptide
IQSFLQQQMNPCKNFLLQQC

SEQ ID NO: 1335 - protein, 20 aa, Artificial Sequence
  Description of Artificial Sequence: Synthetic gluten peptide
QSFLQQQMNPCKNFLLQQCN

SEQ ID NO: 1336 - protein, 20 aa, Artificial Sequence
  Description of Artificial Sequence: Synthetic gluten peptide
IQPYLQQQMNPCKNYLLQQC

SEQ ID NO: 1337 - protein, 20 aa, Artificial Sequence
  Description of Artificial Sequence: Synthetic gluten peptide
PQQQQPAIQSFLQQQMNPCK

SEQ ID NO: 1338 - protein, 20 aa, Artificial Sequence
  Description of Artificial Sequence: Synthetic gluten peptide
IQPYLQQQMNPCKNYLLQQC

SEQ ID NO: 1339 - protein, 20 aa, Artificial Sequence
  Description of Artificial Sequence: Synthetic gluten peptide
LQQQMNPCKNYLLQQCNPVS

SEQ ID NO: 1340 - protein, 20 aa, Artificial Sequence
  Description of Artificial Sequence: Synthetic gluten peptide
SRLLSPRGKELHTPQEQFPQ

SEQ ID NO: 1341 - protein, 20 aa, Artificial Sequence
  Description of Artificial Sequence: Synthetic gluten peptide
SRLLSPRGKELHTPQEQFPQ

SEQ ID NO: 1342 - protein, 20 aa, Artificial Sequence
  Description of Artificial Sequence: Synthetic gluten peptide
IILHQQQQQQQPSSQVSLQQ

SEQ ID NO: 1343 - protein, 20 aa, Artificial Sequence
  Description of Artificial Sequence: Synthetic gluten peptide
ILPRSDCQVMQQQCCQQLAQ

SEQ ID NO: 1344 - protein, 20 aa, Artificial Sequence
  Description of Artificial Sequence: Synthetic gluten peptide
SMILPRSDCQVMQQQCCQQL

SEQ ID NO: 1345 - protein, 20 aa, Artificial Sequence
  Description of Artificial Sequence: Synthetic gluten peptide
VSIILPRSDCQVMQQQCCQQ

SEQ ID NO: 1346 - protein, 20 aa, Artificial Sequence
  Description of Artificial Sequence: Synthetic gluten peptide
QPYLQLQPFSQPQLPYSQPQ

SEQ ID NO: 1347 - protein, 20 aa, Artificial Sequence
  Description of Artificial Sequence: Synthetic gluten peptide
LQLQPFSQPQLPYSQPQPFR

SEQ ID NO: 1348 - protein, 20 aa, Artificial Sequence
  Description of Artificial Sequence: Synthetic gluten peptide
SQQPYLQLQPFSQPQLPYSQ

SEQ ID NO: 1349 - protein, 20 aa, Artificial Sequence
  Description of Artificial Sequence: Synthetic gluten peptide
LQLQPFSQPQLPYSQPQPFR

SEQ ID NO: 1350 - protein, 20 aa, Artificial Sequence
  Description of Artificial Sequence: Synthetic gluten peptide
QQQPILPQLPFSQQQQPVLP

SEQ ID NO: 1351 - protein, 20 aa, Artificial Sequence
  Description of Artificial Sequence: Synthetic gluten peptide
PLISQQQQLPFSQQQQPQFS

SEQ ID NO: 1352 - protein, 20 aa, Artificial Sequence
  Description of Artificial Sequence: Synthetic gluten peptide
PSFLQQQPILPQLPFSQQQQ

SEQ ID NO: 1353 - protein, 20 aa, Artificial Sequence
  Description of Artificial Sequence: Synthetic gluten peptide
PQQPQQPFPLQPQQPFPQQP

SEQ ID NO: 1354 - protein, 20 aa, Artificial Sequence
  Description of Artificial Sequence: Synthetic gluten peptide
PQQPQQPFPLQPQQPFPQQP

SEQ ID NO: 1355 - protein, 20 aa, Artificial Sequence
  Description of Artificial Sequence: Synthetic gluten peptide
PQQLQQPFPLQPQQPFPQQP

SEQ ID NO: 1356 - protein, 20 aa, Artificial Sequence
  Description of Artificial Sequence: Synthetic gluten peptide
PQQPQQPFPLQPQQPFPQQP

SEQ ID NO: 1357 - protein, 20 aa, Artificial Sequence
  Description of Artificial Sequence: Synthetic gluten peptide
PQQPFPLQPQQSFLWQSQQP

SEQ ID NO: 1358 - protein, 20 aa, Artificial Sequence
  Description of Artificial Sequence: Synthetic gluten peptide
SEQIIPQQLQQPFPLQPQQP

SEQ ID NO: 1359 - protein, 20 aa, Artificial Sequence
  Description of Artificial Sequence: Synthetic gluten peptide
PQQPFPLQPQQSFLWQSQQP

SEQ ID NO: 1360 - protein, 20 aa, Artificial Sequence
  Description of Artificial Sequence: Synthetic gluten peptide
PRIPEQSRYDAIRAIIYSIV

SEQ ID NO: 1361 - protein, 20 aa, Artificial Sequence
  Description of Artificial Sequence: Synthetic gluten peptide
QSRYDAIRAIIYSIVLQEQQ

SEQ ID NO: 1362 - protein, 20 aa, Artificial Sequence
  Description of Artificial Sequence: Synthetic gluten peptide
QSRYDAIRAIIYSIVLQEQQ

SEQ ID NO: 1363 - protein, 20 aa, Artificial Sequence
  Description of Artificial Sequence: Synthetic gluten peptide
PRIPEQSRYDAIRAIIYSIV

SEQ ID NO: 1364 - protein, 20 aa, Artificial Sequence
  Description of Artificial Sequence: Synthetic gluten peptide
PRIPEQSRYDAIRAIIYSIV

SEQ ID NO: 1365 - protein, 20 aa, Artificial Sequence
  Description of Artificial Sequence: Synthetic gluten peptide
QSRYDAIRAIIYSIVLQEQQ

SEQ ID NO: 1366 - protein, 20 aa, Artificial Sequence
  Description of Artificial Sequence: Synthetic gluten peptide
PEQSRYDAIRAITYPIILQE

SEQ ID NO: 1367 - protein, 20 aa, Artificial Sequence
  Description of Artificial Sequence: Synthetic gluten peptide
QCCQQLPRIPEQSRYDAIRA

SEQ ID NO: 1368 - protein, 20 aa, Artificial Sequence
  Description of Artificial Sequence: Synthetic gluten peptide
EQSRYDAIRAITYSIILQEQ

SEQ ID NO: 1369 - protein, 20 aa, Artificial Sequence
  Description of Artificial Sequence: Synthetic gluten peptide
QCCQQLPRIPEQSRYDAIRA

SEQ ID NO: 1370 - protein, 20 aa, Artificial Sequence
  Description of Artificial Sequence: Synthetic gluten peptide
QSRYDAIRAIIYSIVLQEQQ

SEQ ID NO: 1371 - protein, 20 aa, Artificial Sequence
  Description of Artificial Sequence: Synthetic gluten peptide
PRIPEQSRYDAIRAIIYSIV

SEQ ID NO: 1372 - protein, 20 aa, Artificial Sequence
  Description of Artificial Sequence: Synthetic gluten peptide
FLQQPQQPSPQPQQVVQIIS

SEQ ID NO: 1373 - protein, 20 aa, Artificial Sequence
  Description of Artificial Sequence: Synthetic gluten peptide
SQQPFLQQPQQPSPQPQQVV

SEQ ID NO: 1374 - protein, 20 aa, Artificial Sequence
  Description of Artificial Sequence: Synthetic gluten peptide
PQQPSPQPQQVVQIISPATP

SEQ ID NO: 1375 - protein, 20 aa, Artificial Sequence
  Description of Artificial Sequence: Synthetic gluten peptide
QPPFSLHQQPVLPQQQIPYV

SEQ ID NO: 1376 - protein, 20 aa, Artificial Sequence
  Description of Artificial Sequence: Synthetic gluten peptide
QPPFSLHQQPVLPQQQIPYV

SEQ ID NO: 1377 - protein, 20 aa, Artificial Sequence
  Description of Artificial Sequence: Synthetic gluten peptide
QPILPQQPPFSLHQQPVLPQ

SEQ ID NO: 1378 - protein, 20 aa, Artificial Sequence
  Description of Artificial Sequence: Synthetic gluten peptide
QPILPQQPPFSLHQQPVLPQ

SEQ ID NO: 1379 - protein, 20 aa, Artificial Sequence
  Description of Artificial Sequence: Synthetic gluten peptide
QQQQQPILPQQPPFSLHQQP

SEQ ID NO: 1380 - protein, 20 aa, Artificial Sequence
  Description of Artificial Sequence: Synthetic gluten peptide
QPPFSLHQQPVLPQQQIPYV

SEQ ID NO: 1381 - protein, 20 aa, Artificial Sequence
  Description of Artificial Sequence: Synthetic gluten peptide
QPPFSLHQQPVLPQQQIPYV

SEQ ID NO: 1382 - protein, 20 aa, Artificial Sequence
  Description of Artificial Sequence: Synthetic gluten peptide
QPILPQQPPFSLHQQPVLPQ

SEQ ID NO: 1383 - protein, 20 aa, Artificial Sequence
  Description of Artificial Sequence: Synthetic gluten peptide
QPILPQQPPFSLHQQPVLPQ

SEQ ID NO: 1384 - protein, 20 aa, Artificial Sequence
  Description of Artificial Sequence: Synthetic gluten peptide
DAIRAITYPIILQEQQQGFV

SEQ ID NO: 1385 - protein, 20 aa, Artificial Sequence
  Description of Artificial Sequence: Synthetic gluten peptide
PFSQQQQPPFSQQQQPVLPQ

SEQ ID NO: 1386 - protein, 20 aa, Artificial Sequence
  Description of Artificial Sequence: Synthetic gluten peptide
QQPPFSQQQQPPFSQQPLIS

SEQ ID NO: 1387 - protein, 20 aa, Artificial Sequence
  Description of Artificial Sequence: Synthetic gluten peptide
QPSFSQQQQPPFSQQQPPFS

SEQ ID NO: 1388 - protein, 20 aa, Artificial Sequence
  Description of Artificial Sequence: Synthetic gluten peptide
QQQQPFTQQQQPPFSQQPPI

SEQ ID NO: 1389 - protein, 20 aa, Artificial Sequence
  Description of Artificial Sequence: Synthetic gluten peptide
PPFSQQQQPSFSQQQQPPFS

SEQ ID NO: 1390 - protein, 20 aa, Artificial Sequence
  Description of Artificial Sequence: Synthetic gluten peptide
QQQQPPFSQQQQPPFSQQQQ

SEQ ID NO: 1391 - protein, 20 aa, Artificial Sequence
  Description of Artificial Sequence: Synthetic gluten peptide
SQQQQAPPFSQQQQPPFSQQ

SEQ ID NO: 1392 - protein, 20 aa, Artificial Sequence
  Description of Artificial Sequence: Synthetic gluten peptide
FSQQQQPQFSQQQQPPYSQQ

SEQ ID NO: 1393 - protein, 20 aa, Artificial Sequence
  Description of Artificial Sequence: Synthetic gluten peptide
PSFSQQQQQPPFTQQQQPPF

SEQ ID NO: 1394 - protein, 20 aa, Artificial Sequence
  Description of Artificial Sequence: Synthetic gluten peptide
VLPQQPPFSQQQQPPFRSST

SEQ ID NO: 1395 - protein, 20 aa, Artificial Sequence
  Description of Artificial Sequence: Synthetic gluten peptide
ISQQQQAPPFSQQQQPPFSQ

SEQ ID NO: 1396 - protein, 20 aa, Artificial Sequence
  Description of Artificial Sequence: Synthetic gluten peptide
PPFSQQQQPPFSQQQQSPFS

SEQ ID NO: 1397 - protein, 20 aa, Artificial Sequence
  Description of Artificial Sequence: Synthetic gluten peptide
FSQQQQPPFRSSTHSSQQPP

SEQ ID NO: 1398 - protein, 20 aa, Artificial Sequence
  Description of Artificial Sequence: Synthetic gluten peptide
ISQQQQPPPFSQQQQPPFSQ

SEQ ID NO: 1399 - protein, 20 aa, Artificial Sequence
  Description of Artificial Sequence: Synthetic gluten peptide
QPPYSQQQQPPYSQQQQPPF

SEQ ID NO: 1400 - protein, 20 aa, Artificial Sequence
  Description of Artificial Sequence: Synthetic gluten peptide
QRQLPPFSQQQQPPFSQQQQ

SEQ ID NO: 1401 - protein, 20 aa, Artificial Sequence
  Description of Artificial Sequence: Synthetic gluten peptide
FSQQQQPPFSQQQQPPYSQQ

SEQ ID NO: 1402 - protein, 20 aa, Artificial Sequence
  Description of Artificial Sequence: Synthetic gluten peptide
EQQPPFSQQQQPPFSQQQQP

SEQ ID NO: 1403 - protein, 20 aa, Artificial Sequence
  Description of Artificial Sequence: Synthetic gluten peptide
PFSQQQQPPFSQHQQPVLPQ

SEQ ID NO: 1404 - protein, 20 aa, Artificial Sequence
  Description of Artificial Sequence: Synthetic gluten peptide
YSQQQQPPYSQQQQPPFSQQ

SEQ ID NO: 1405 - protein, 20 aa, Artificial Sequence
  Description of Artificial Sequence: Synthetic gluten peptide
QQQQQQQQPFTQQQQPPFSQ

SEQ ID NO: 1406 - protein, 20 aa, Artificial Sequence
  Description of Artificial Sequence: Synthetic gluten peptide
FSQQQQPPFSQQQQQPPFTQ

SEQ ID NO: 1407 - protein, 20 aa, Artificial Sequence
  Description of Artificial Sequence: Synthetic gluten peptide
QQQQPPFSQEQQPPFSQQQQ

SEQ ID NO: 1408 - protein, 20 aa, Artificial Sequence
  Description of Artificial Sequence: Synthetic gluten peptide
FTQQQQPPFSQQSPISQQQQ

SEQ ID NO: 1409 - protein, 20 aa, Artificial Sequence
  Description of Artificial Sequence: Synthetic gluten peptide
NIQQQQPPFSQQQQPPFSQQ

SEQ ID NO: 1410 - protein, 20 aa, Artificial Sequence
  Description of Artificial Sequence: Synthetic gluten peptide
QQQPPFTQQQQPPFSQQSPI

SEQ ID NO: 1411 - protein, 20 aa, Artificial Sequence
  Description of Artificial Sequence: Synthetic gluten peptide
SQHQQPVLPQQQIPSVQPSI

SEQ ID NO: 1412 - protein, 20 aa, Artificial Sequence
  Description of Artificial Sequence: Synthetic gluten peptide
QQPLFSQKQQPVLPQQPAFS

SEQ ID NO: 1413 - protein, 20 aa, Artificial Sequence
  Description of Artificial Sequence: Synthetic gluten peptide
PLFSQKQQPVLPQQPPFSQQ

SEQ ID NO: 1414 - protein, 20 aa, Artificial Sequence
  Description of Artificial Sequence: Synthetic gluten peptide
SQQQQPPFSQHQQPVLPQQQ

SEQ ID NO: 1415 - protein, 20 aa, Artificial Sequence
  Description of Artificial Sequence: Synthetic gluten peptide
PFSQQQQPPFSQHQQPVLPQ

SEQ ID NO: 1416 - protein, 20 aa, Artificial Sequence
  Description of Artificial Sequence: Synthetic gluten peptide
FSQQQPPFSQQTQPVLPQQS

SEQ ID NO: 1417 - protein, 20 aa, Artificial Sequence
  Description of Artificial Sequence: Synthetic gluten peptide
FTQQQQPPFSQQSPISQQQQ

SEQ ID NO: 1418 - protein, 20 aa, Artificial Sequence
  Description of Artificial Sequence: Synthetic gluten peptide
QQQPPFTQQQQPPFSQQSPI

SEQ ID NO: 1419 - protein, 20 aa, Artificial Sequence
  Description of Artificial Sequence: Synthetic gluten peptide
QQQQQQQQQPLSQVSFQQPQ

SEQ ID NO: 1420 - protein, 20 aa, Artificial Sequence
  Description of Artificial Sequence: Synthetic gluten peptide
QQQQQQQQQPLSQVCFQQSQ

SEQ ID NO: 1421 - protein, 20 aa, Artificial Sequence
  Description of Artificial Sequence: Synthetic gluten peptide
PFSQQQQQQQQQQPPFSQQQ

SEQ ID NO: 1422 - protein, 15 aa, Artificial Sequence
  Description of Artificial Sequence: Synthetic gluten peptide
GSGQQQQQQEQPGSG

SEQ ID NO: 1423 - protein, 20 aa, Artificial Sequence
  Description of Artificial Sequence: Synthetic gluten peptide
PPFSQQQQQQQQPFPQQPSF

SEQ ID NO: 1424 - protein, 20 aa, Artificial Sequence
  Description of Artificial Sequence: Synthetic gluten peptide
QQQQSPFSQQQEQQQQPPFL

SEQ ID NO: 1425 - protein, 20 aa, Artificial Sequence
  Description of Artificial Sequence: Synthetic gluten peptide
SPISQQQQQQQQQQQQPFTQ

SEQ ID NO: 1426 - protein, 20 aa, Artificial Sequence
  Description of Artificial Sequence: Synthetic gluten peptide
SQQQEQQQQPPFLQQQQPPF

SEQ ID NO: 1427 - protein, 16 aa, Artificial Sequence
  Description of Artificial Sequence: Synthetic gluten peptide
GQQQQQQQEQPLSQVG

SEQ ID NO: 1428 - protein, 20 aa, Artificial Sequence
  Description of Artificial Sequence: Synthetic gluten peptide
QQLQQQQQQQQQQQQPSSQV

SEQ ID NO: 1429 - protein, 20 aa, Artificial Sequence
  Description of Artificial Sequence: Synthetic gluten peptide
QQQQPPFTQQQQQQQQQQPF

SEQ ID NO: 1430 - protein, 16 aa, Artificial Sequence
  Description of Artificial Sequence: Synthetic gluten peptide
GQQQQQQQQQPLSQVG

SEQ ID NO: 1431 - protein, 20 aa, Artificial Sequence
  Description of Artificial Sequence: Synthetic gluten peptide
QQQQQQQQQPSSQVSFQQPQ

SEQ ID NO: 1432 - protein, 20 aa, Artificial Sequence
  Description of Artificial Sequence: Synthetic gluten peptide
QQQQQQQQPFTQQQQPPFSQ

SEQ ID NO: 1433 - protein, 20 aa, Artificial Sequence
  Description of Artificial Sequence: Synthetic gluten peptide
QQPPFSQQQQQQQQQPFPQQ

SEQ ID NO: 1434 - protein, 20 aa, Artificial Sequence
  Description of Artificial Sequence: Synthetic gluten peptide
QQLQQQQQQQQQQPLSQVCF

SEQ ID NO: 1435 - protein, 20 aa, Artificial Sequence
  Description of Artificial Sequence: Synthetic gluten peptide
QQLQQQQQQQQQQPLSQVSF

SEQ ID NO: 1436 - protein, 20 aa, Artificial Sequence
  Description of Artificial Sequence: Synthetic gluten peptide
ILHQQHHHHQQQQQQQQQQP

SEQ ID NO: 1437 - protein, 20 aa, Artificial Sequence
  Description of Artificial Sequence: Synthetic gluten peptide
QQPPFSQQQQQQQQQPPFSQ

SEQ ID NO: 1438 - protein, 20 aa, Artificial Sequence
  Description of Artificial Sequence: Synthetic gluten peptide
QQQQQQQQQPLSQVSFQQPQ

SEQ ID NO: 1439 - protein, 20 aa, Artificial Sequence
  Description of Artificial Sequence: Synthetic gluten peptide
HHHQQQQQQQQQQPLSQVSF

SEQ ID NO: 1440 - protein, 20 aa, Artificial Sequence
  Description of Artificial Sequence: Synthetic gluten peptide
AIILHQQQQQQQQQQQQPLS

SEQ ID NO: 1441 - protein, 20 aa, Artificial Sequence
  Description of Artificial Sequence: Synthetic gluten peptide
PFSQQQQQQQQQQPPFSQQQ

SEQ ID NO: 1442 - protein, 20 aa, Artificial Sequence
  Description of Artificial Sequence: Synthetic gluten peptide
SQQQPPFSQQQQQPPFSQQQ

SEQ ID NO: 1443 - protein, 20 aa, Artificial Sequence
  Description of Artificial Sequence: Synthetic gluten peptide
ISQQQQQPPFSQQQQPQFSQ

SEQ ID NO: 1444 - protein, 20 aa, Artificial Sequence
  Description of Artificial Sequence: Synthetic gluten peptide
PSFSQQQQQPPFTQQQQPPF

SEQ ID NO: 1445 - protein, 20 aa, Artificial Sequence
  Description of Artificial Sequence: Synthetic gluten peptide
FSQQQQPPFSQQQQQPPFTQ

SEQ ID NO: 1446 - protein, 20 aa, Artificial Sequence
  Description of Artificial Sequence: Synthetic gluten peptide
QQPPFSQQQQQQQQQPPFSQ

SEQ ID NO: 1447 - protein, 20 aa, Artificial Sequence
  Description of Artificial Sequence: Synthetic gluten peptide
QIPSVQPSILQQLNPCKLFL

SEQ ID NO: 1448 - protein, 20 aa, Artificial Sequence
  Description of Artificial Sequence: Synthetic gluten peptide
PVLPQQQIPSVQPSILQQLN

SEQ ID NO: 1449 - protein, 20 aa, Artificial Sequence
  Description of Artificial Sequence: Synthetic gluten peptide
QQQLGQCSFQQPQQQLGQQP

SEQ ID NO: 1450 - protein, 20 aa, Artificial Sequence
  Description of Artificial Sequence: Synthetic gluten peptide
QLSSQVSFQQPQQQLGQQPQ

SEQ ID NO: 1451 - protein, 20 aa, Artificial Sequence
  Description of Artificial Sequence: Synthetic gluten peptide
SFQQPQQQLGQQPQQQQQQV

SEQ ID NO: 1452 - protein, 20 aa, Artificial Sequence
  Description of Artificial Sequence: Synthetic gluten peptide
QPQQQLGQQPQQQQQQQVLQ

SEQ ID NO: 1453 - protein, 20 aa, Artificial Sequence
  Description of Artificial Sequence: Synthetic gluten peptide
SFQQPQQQLGQQPQQQQQQV

SEQ ID NO: 1454 - protein, 20 aa, Artificial Sequence
  Description of Artificial Sequence: Synthetic gluten peptide
QQQLGQCSFQQPQQQLGQQP

SEQ ID NO: 1455 - protein, 20 aa, Artificial Sequence
  Description of Artificial Sequence: Synthetic gluten peptide
CSFQQPQQQLGQQPQQQQQQ

SEQ ID NO: 1456 - protein, 20 aa, Artificial Sequence
  Description of Artificial Sequence: Synthetic gluten peptide
QQQLGQCSFQQPQQQLGQQP

SEQ ID NO: 1457 - protein, 20 aa, Artificial Sequence
  Description of Artificial Sequence: Synthetic gluten peptide
LGQCSFQQPQQQQLGQWPQQ

SEQ ID NO: 1458 - protein, 20 aa, Artificial Sequence
  Description of Artificial Sequence: Synthetic gluten peptide
SQQQLLQCSFQQPQQQLGQQ

SEQ ID NO: 1459 - protein, 20 aa, Artificial Sequence
  Description of Artificial Sequence: Synthetic gluten peptide
QSQQQLGQCSFQQPQQQLGQ

SEQ ID NO: 1460 - protein, 20 aa, Artificial Sequence
  Description of Artificial Sequence: Synthetic gluten peptide
QQQLGQCSFQQPQQQLGQQP

SEQ ID NO: 1461 - protein, 20 aa, Artificial Sequence
  Description of Artificial Sequence: Synthetic gluten peptide
CSFQQPQQQLGQQPQQQQQQ

SEQ ID NO: 1462 - protein, 16 aa, Artificial Sequence
  Description of Artificial Sequence: Synthetic gluten peptide
GPLRELCCQHLWQIPG

SEQ ID NO: 1463 - protein, 20 aa, Artificial Sequence
  Description of Artificial Sequence: Synthetic gluten peptide
QSTYQLLRELCCQHLWQIPE

SEQ ID NO: 1464 - protein, 20 aa, Artificial Sequence
  Description of Artificial Sequence: Synthetic gluten peptide
QSTYQLLRELCCQHLWQIPE

SEQ ID NO: 1465 - protein, 16 aa, Artificial Sequence
  Description of Artificial Sequence: Synthetic gluten peptide
GPLRELCCEHLWQIPG

SEQ ID NO: 1466 - protein, 20 aa, Artificial Sequence
  Description of Artificial Sequence: Synthetic gluten peptide
QSTYQLLRELCCQHLWQIPE

SEQ ID NO: 1467 - protein, 20 aa, Artificial Sequence
  Description of Artificial Sequence: Synthetic gluten peptide
PEPPFSLQQQPVLPQQSPFS

SEQ ID NO: 1468 - protein, 20 aa, Artificial Sequence
  Description of Artificial Sequence: Synthetic gluten peptide
QQPILPEPPFSLQQQPVLPQ

SEQ ID NO: 1469 - protein, 20 aa, Artificial Sequence
  Description of Artificial Sequence: Synthetic gluten peptide
PSFLQQQPILPQLPFSQQQQ

SEQ ID NO: 1470 - protein, 20 aa, Artificial Sequence
  Description of Artificial Sequence: Synthetic gluten peptide
PFSQQQPSFLQQQPILPQLP

SEQ ID NO: 1471 - protein, 20 aa, Artificial Sequence
  Description of Artificial Sequence: Synthetic gluten peptide
QRPPFSQQQQQPVLPQQPPF

SEQ ID NO: 1472 - protein, 20 aa, Artificial Sequence
  Description of Artificial Sequence: Synthetic gluten peptide
LQQPPFSQQRPPFSQQQQQP

SEQ ID NO: 1473 - protein, 20 aa, Artificial Sequence
  Description of Artificial Sequence: Synthetic gluten peptide
QRPPFSQQQQQPVLPQQPPF

SEQ ID NO: 1474 - protein, 20 aa, Artificial Sequence
  Description of Artificial Sequence: Synthetic gluten peptide
LQQPPFSQQRPPFSQQQQQP

SEQ ID NO: 1475 - protein, 20 aa, Artificial Sequence
  Description of Artificial Sequence: Synthetic gluten peptide
SVLQQLNPCMVFLQQQCIPV

SEQ ID NO: 1476 - protein, 20 aa, Artificial Sequence
  Description of Artificial Sequence: Synthetic gluten peptide
MVFLQQQCIPVAMQRCLARS

SEQ ID NO: 1477 - protein, 20 aa, Artificial Sequence
  Description of Artificial Sequence: Synthetic gluten peptide
QQSFPQQQRPFIQPSLQQQL

SEQ ID NO: 1478 - protein, 20 aa, Artificial Sequence
  Description of Artificial Sequence: Synthetic gluten peptide
QPQQPQQSFPQQQRPFIQPS

SEQ ID NO: 1479 - protein, 20 aa, Artificial Sequence
  Description of Artificial Sequence: Synthetic gluten peptide
FPQQQRPFIQPSLQQQLNPC

SEQ ID NO: 1480 - protein, 20 aa, Artificial Sequence
  Description of Artificial Sequence: Synthetic gluten peptide
GYYPTFPQLPGQLQQPAQGQ

SEQ ID NO: 1481 - protein, 16 aa, Artificial Sequence
  Description of Artificial Sequence: Synthetic gluten peptide
GGQVQWLQEQLVPQLG

SEQ ID NO: 1482 - protein, 20 aa, Artificial Sequence
  Description of Artificial Sequence: Synthetic gluten peptide
PSGQVQWLQQQLVPQLQQPL

SEQ ID NO: 1483 - protein, 16 aa, Artificial Sequence
  Description of Artificial Sequence: Synthetic gluten peptide
GGQVQWLEEQLVPQLG

SEQ ID NO: 1484 - protein, 16 aa, Artificial Sequence
  Description of Artificial Sequence: Synthetic gluten peptide
GGQVQWLQQQLVPQLG

SEQ ID NO: 1485 - protein, 20 aa, Artificial Sequence
  Description of Artificial Sequence: Synthetic gluten peptide
PSGQVQWLQQQLVPQLQQPL

SEQ ID NO: 1486 - protein, 20 aa, Artificial Sequence
  Description of Artificial Sequence: Synthetic gluten peptide
FPQQQPPFIQPSLQQQVNPC

SEQ ID NO: 1487 - protein, 20 aa, Artificial Sequence
  Description of Artificial Sequence: Synthetic gluten peptide
PQQQPPFIQPSLQQQVNPCK

SEQ ID NO: 1488 - protein, 20 aa, Artificial Sequence
  Description of Artificial Sequence: Synthetic gluten peptide
QQPQQSFPQQQPPFIQPSLQ

SEQ ID NO: 1489 - protein, 20 aa, Artificial Sequence
  Description of Artificial Sequence: Synthetic gluten peptide
QQPLFSQKQQPVLPQQPAFS

SEQ ID NO: 1490 - protein, 20 aa, Artificial Sequence
  Description of Artificial Sequence: Synthetic gluten peptide
KQQPVLPQQPAFSQQQQTVL

SEQ ID NO: 1491 - protein, 20 aa, Artificial Sequence
  Description of Artificial Sequence: Synthetic gluten peptide
QQQTVLPQQPAFSQQQHQQL

SEQ ID NO: 1492 - protein, 20 aa, Artificial Sequence
  Description of Artificial Sequence: Synthetic gluten peptide
LQQPQQPFPQPQQQLPQPQQ

SEQ ID NO: 1493 - protein, 16 aa, Artificial Sequence
  Description of Artificial Sequence: Synthetic gluten peptide
GQQPFPQPEQQLPQPG

SEQ ID NO: 1494 - protein, 20 aa, Artificial Sequence
  Description of Artificial Sequence: Synthetic gluten peptide
LQQPQQPFPQPQQQLPQPQQ

SEQ ID NO: 1495 - protein, 16 aa, Artificial Sequence
  Description of Artificial Sequence: Synthetic gluten peptide
GQQPFPQPQQQLPQPG

SEQ ID NO: 1496 - protein, 20 aa, Artificial Sequence
  Description of Artificial Sequence: Synthetic gluten peptide
QPFPQPQQQLPQPQQPQQSF

SEQ ID NO: 1497 - protein, 20 aa, Artificial Sequence
  Description of Artificial Sequence: Synthetic gluten peptide
PQPQQQLPQPQQPQQSFPQQ

SEQ ID NO: 1498 - protein, 20 aa, Artificial Sequence
  Description of Artificial Sequence: Synthetic gluten peptide
GTANMQVDPSSQVQWPQQQP

SEQ ID NO: 1499 - protein, 20 aa, Artificial Sequence
  Description of Artificial Sequence: Synthetic gluten peptide
GTANMQVDPSSQVQWPQQQP

SEQ ID NO: 1500 - protein, 20 aa, Artificial Sequence
  Description of Artificial Sequence: Synthetic gluten peptide
GTANMQVDPSSQVQWPQQQP

SEQ ID NO: 1501 - protein, 20 aa, Artificial Sequence
  Description of Artificial Sequence: Synthetic gluten peptide
QQQQQQQQQGMHIFLPLSQQ

SEQ ID NO: 1502 - protein, 20 aa, Artificial Sequence
  Description of Artificial Sequence: Synthetic gluten peptide
IMQQQQQQQQQQGMHIFLPL

SEQ ID NO: 1503 - protein, 20 aa, Artificial Sequence
  Description of Artificial Sequence: Synthetic gluten peptide
QQQQGMHIFLPLSQQQQVGQ

SEQ ID NO: 1504 - protein, 20 aa, Artificial Sequence
  Description of Artificial Sequence: Synthetic gluten peptide
CQAIHKVVHAIILHQQQKQQ

SEQ ID NO: 1505 - protein, 20 aa, Artificial Sequence
  Description of Artificial Sequence: Synthetic gluten peptide
QAIHKVVHAIILHQQQKQQQ

SEQ ID NO: 1506 - protein, 20 aa, Artificial Sequence
  Description of Artificial Sequence: Synthetic gluten peptide
LRTLPMMCSVNVPVYGTTTS

SEQ ID NO: 1507 - protein, 20 aa, Artificial Sequence
  Description of Artificial Sequence: Synthetic gluten peptide
LPTMCGVNVPLYGTTTSVPF

SEQ ID NO: 1508 - protein, 20 aa, Artificial Sequence
  Description of Artificial Sequence: Synthetic gluten peptide
VPVYGTTTSVPFGVGTQVGA

SEQ ID NO: 1509 - protein, 20 aa, Artificial Sequence
  Description of Artificial Sequence: Synthetic gluten peptide
CSVNVPVYGTTTSVPFGVGT

SEQ ID NO: 1510 - protein, 20 aa, Artificial Sequence
  Description of Artificial Sequence: Synthetic gluten peptide
PQPQQLGQQPQQQEVPQVAF

SEQ ID NO: 1511 - protein, 20 aa, Artificial Sequence
  Description of Artificial Sequence: Synthetic gluten peptide
QCSFQQPQPQQLGQQPQQQE

SEQ ID NO: 1512 - protein, 20 aa, Artificial Sequence
  Description of Artificial Sequence: Synthetic gluten peptide
QGVSQPQQQSGQQQLVQCSF

SEQ ID NO: 1513 - protein, 20 aa, Artificial Sequence
  Description of Artificial Sequence: Synthetic gluten peptide
QSGQQQLVQCSFQQPQPQQL

SEQ ID NO: 1514 - protein, 20 aa, Artificial Sequence
  Description of Artificial Sequence: Synthetic gluten peptide
PQPFPPQLPYPQPQLPYPQP

SEQ ID NO: 1515 - protein, 20 aa, Artificial Sequence
  Description of Artificial Sequence: Synthetic gluten peptide
PQPFPPQLPYPQPQLPYPQP

SEQ ID NO: 1516 - protein, 20 aa, Artificial Sequence
  Description of Artificial Sequence: Synthetic gluten peptide
QPFPPQLPYPQPQPFRPQQP

SEQ ID NO: 1517 - protein, 20 aa, Artificial Sequence
  Description of Artificial Sequence: Synthetic gluten peptide
PQPFPPQLPYPQPQLPYPQP

SEQ ID NO: 1518 - protein, 20 aa, Artificial Sequence
  Description of Artificial Sequence: Synthetic gluten peptide
LQLQPFPQPQPFPPQLPYPQ

SEQ ID NO: 1519 - protein, 20 aa, Artificial Sequence
  Description of Artificial Sequence: Synthetic gluten peptide
PQPFPPQLPYPQPQPFRPQQ

SEQ ID NO: 1520 - protein, 20 aa, Artificial Sequence
  Description of Artificial Sequence: Synthetic gluten peptide
PQPFPPQLPYPQPPPFSPQQ

SEQ ID NO: 1521 - protein, 20 aa, Artificial Sequence
  Description of Artificial Sequence: Synthetic gluten peptide
LQLQPFPQPQPFPPQLPYPQ

SEQ ID NO: 1522 - protein, 20 aa, Artificial Sequence
  Description of Artificial Sequence: Synthetic gluten peptide
PQPFPPQLPYPQPQSFPPQQ

SEQ ID NO: 1523 - protein, 20 aa, Artificial Sequence
  Description of Artificial Sequence: Synthetic gluten peptide
MQLQPFPQPQPFPPQLPYPQ

SEQ ID NO: 1524 - protein, 16 aa, Artificial Sequence
  Description of Artificial Sequence: Synthetic gluten peptide
GQPQPFPPELPYPQPG

SEQ ID NO: 1525 - protein, 16 aa, Artificial Sequence
  Description of Artificial Sequence: Synthetic gluten peptide
GQPQPFPPQLPYPQPG

SEQ ID NO: 1526 - protein, 20 aa, Artificial Sequence
  Description of Artificial Sequence: Synthetic gluten peptide
PFPQPQPFPPQLPYPQPPPF

SEQ ID NO: 1527 - protein, 20 aa, Artificial Sequence
  Description of Artificial Sequence: Synthetic gluten peptide
PFPQPQPFPPQLPYPQPQSF

SEQ ID NO: 1528 - protein, 20 aa, Artificial Sequence
  Description of Artificial Sequence: Synthetic gluten peptide
PQPQPFPQPQPFPPQLPYPQ

SEQ ID NO: 1529 - protein, 20 aa, Artificial Sequence
  Description of Artificial Sequence: Synthetic gluten peptide
PQPFPPQLPYPQPPPFSPQQ

SEQ ID NO: 1530 - protein, 15 aa, Artificial Sequence
  Description of Artificial Sequence: Synthetic gluten peptide
GSGFPPELPYPQGSG

SEQ ID NO: 1531 - protein, 20 aa, Artificial Sequence
  Description of Artificial Sequence: Synthetic gluten peptide
PQPQPFPPQLPYPQTQPFPP

SEQ ID NO: 1532 - protein, 20 aa, Artificial Sequence
  Description of Artificial Sequence: Synthetic gluten peptide
PQPFPPQLPYPQTQPFPPQQ

SEQ ID NO: 1533 - protein, 20 aa, Artificial Sequence
  Description of Artificial Sequence: Synthetic gluten peptide
QPFPPQLPYPQTQPFPPQQP

SEQ ID NO: 1534 - protein, 20 aa, Artificial Sequence
  Description of Artificial Sequence: Synthetic gluten peptide
CKVFLQQQCSPVAMPQRLAR

SEQ ID NO: 1535 - protein, 16 aa, Artificial Sequence
  Description of Artificial Sequence: Synthetic gluten peptide
LQQQCSPVAMPQRLAR

SEQ ID NO: 1536 - protein, 20 aa, Artificial Sequence
  Description of Artificial Sequence: Synthetic gluten peptide
VFLQQCSPVAMPQRLARSQM

SEQ ID NO: 1537 - protein, 20 aa, Artificial Sequence
  Description of Artificial Sequence: Synthetic gluten peptide
LNPCKVFLQQQCSPVAMPQR

SEQ ID NO: 1538 - protein, 20 aa, Artificial Sequence
  Description of Artificial Sequence: Synthetic gluten peptide
QQQCSPVAMPQRLARSQMWQ

SEQ ID NO: 1539 - protein, 20 aa, Artificial Sequence
  Description of Artificial Sequence: Synthetic gluten peptide
CSPVAMPQRLARSQMWQQSS

SEQ ID NO: 1540 - protein, 20 aa, Artificial Sequence
  Description of Artificial Sequence: Synthetic gluten peptide
QCSPVAMPQHLARSQMWQQS

SEQ ID NO: 1541 - protein, 20 aa, Artificial Sequence
  Description of Artificial Sequence: Synthetic gluten peptide
CKVFLQQQCSPVAMPQRLAR

SEQ ID NO: 1542 - protein, 20 aa, Artificial Sequence
  Description of Artificial Sequence: Synthetic gluten peptide
QLNPCKVFLQQCSPVAMPQR

SEQ ID NO: 1543 - protein, 20 aa, Artificial Sequence
  Description of Artificial Sequence: Synthetic gluten peptide
QQQCSPVAMPQRLARSQMWQ

SEQ ID NO: 1544 - protein, 20 aa, Artificial Sequence
  Description of Artificial Sequence: Synthetic gluten peptide
VFLQQQCSPVAMPQHLARSQ

SEQ ID NO: 1545 - protein, 20 aa, Artificial Sequence
  Description of Artificial Sequence: Synthetic gluten peptide
VFLQQQCSPVAMPQRLARSQ

SEQ ID NO: 1546 - protein, 20 aa, Artificial Sequence
  Description of Artificial Sequence: Synthetic gluten peptide
SGQRQQDQQSGQGQQPGQRQ

SEQ ID NO: 1547 - protein, 20 aa, Artificial Sequence
  Description of Artificial Sequence: Synthetic gluten peptide
TTPPQQLQQSILWGIPALLR

SEQ ID NO: 1548 - protein, 20 aa, Artificial Sequence
  Description of Artificial Sequence: Synthetic gluten peptide
QQPPFSQQELPILPQQPPFS

SEQ ID NO: 1549 - protein, 20 aa, Artificial Sequence
  Description of Artificial Sequence: Synthetic gluten peptide
QQQPPFSQQQPPFSQQELPI

SEQ ID NO: 1550 - protein, 20 aa, Artificial Sequence
  Description of Artificial Sequence: Synthetic gluten peptide
FSQQQPPFSQQELPILPQQP

SEQ ID NO: 1551 - protein, 20 aa, Artificial Sequence
  Description of Artificial Sequence: Synthetic gluten peptide
METSHIPGLEKPSQQQPLPL

SEQ ID NO: 1552 - protein, 20 aa, Artificial Sequence
  Description of Artificial Sequence: Synthetic gluten peptide
METSRVPGLEKPWQQQPLPP

SEQ ID NO: 1553 - protein, 20 aa, Artificial Sequence
  Description of Artificial Sequence: Synthetic gluten peptide
LMTSIALRTLPMMCSVNVPV

SEQ ID NO: 1554 - protein, 20 aa, Artificial Sequence
  Description of Artificial Sequence: Synthetic gluten peptide
HLEVMTSIALRTLPMMCSVN

SEQ ID NO: 1555 - protein, 9 aa, Artificial Sequence
  Description of Artificial Sequence: Synthetic gluten peptide
  MOD_RES (2)..(2): Q or R
  MOD_RES (7)..(7): F or Y
PXPZLPXPQ

SEQ ID NO: 1556 - protein, 20 aa, Artificial Sequence
  Description of Artificial Sequence: Synthetic gluten peptide
PQLPYPQPQLPYPQPQPFRP

SEQ ID NO: 1557 - protein, 17 aa, Artificial Sequence
  Description of Artificial Sequence: Synthetic gluten peptide
QLQPFPQPELPYPQPQP

SEQ ID NO: 1558 - protein, 9 aa, Artificial Sequence
  Description of Artificial Sequence: Synthetic gluten peptide
  MOD_RES (2)..(2): F or Y
  MOD_RES (4)..(4): Q or R
  MOD_RES (9)..(9): F or Y
PXPXPZLPX

SEQ ID NO: 1559 - protein, 20 aa, Artificial Sequence
  Description of Artificial Sequence: Synthetic gluten peptide
PQLPYPQPQLPYPQPQPFRP

SEQ ID NO: 1560 - protein, 17 aa, Artificial Sequence
  Description of Artificial Sequence: Synthetic gluten peptide
QLQPFPQPELPYPQPQP

SEQ ID NO: 1561 - protein, 9 aa, Artificial Sequence
  Description of Artificial Sequence: Synthetic gluten peptide
  MOD_RES (1)..(1): P or I or A or T
  MOD_RES (5)..(5): P or T
  MOD_RES (8)..(8): P or T or S
  MOD_RES (9)..(9): F or I or T or Y
XFPQXZQXX

SEQ ID NO: 1562 - protein, 20 aa, Artificial Sequence
  Description of Artificial Sequence: Synthetic gluten peptide
QPFPQPQQPFPWQPQQPFPQ

SEQ ID NO: 1563 - protein, 16 aa, Artificial Sequence
  Description of Artificial Sequence: Synthetic gluten peptide
GQQPFPQPEQPFPWQG

SEQ ID NO: 1564 - protein, 16 aa, Artificial Sequence
  Description of Artificial Sequence: Synthetic gluten peptide
GQQPFPQPEQPIPVQG

SEQ ID NO: 1565 - protein, 9 aa, Artificial Sequence
  Description of Artificial Sequence: Synthetic gluten peptide
  MOD_RES (3)..(3): P or T
  MOD_RES (6)..(6): P or T or S
  MOD_RES (7)..(7): F or I or Y
  MOD_RES (8)..(8): P or S
  MOD_RES (9)..(9): V or W or H or Q or L
PQXZQXXXX

SEQ ID NO: 1566 - protein, 20 aa, Artificial Sequence
  Description of Artificial Sequence: Synthetic gluten peptide
QPFPQPQQPFPWQPQQPFPQ

SEQ ID NO: 1567 - protein, 16 aa, Artificial Sequence
  Description of Artificial Sequence: Synthetic gluten peptide
GQQPFPQPEQPFPWQG

SEQ ID NO: 1568 - protein, 16 aa, Artificial Sequence
  Description of Artificial Sequence: Synthetic gluten peptide
GQQPFPQPEQPIPVQG

SEQ ID NO: 1569 - protein, 9 aa, Artificial Sequence
  Description of Artificial Sequence: Synthetic gluten peptide
  MOD_RES (1)..(1): K or Q or W
  MOD_RES (2)..(2): Q or R
  MOD_RES (6)..(6): S or P or I or T
  MOD_RES (7)..(7): F or L or Y
XXPZQXXPQ

SEQ ID NO: 1570 - protein, 20 aa, Artificial Sequence
  Description of Artificial Sequence: Synthetic gluten peptide
QPQLPFPQQPQQQPQQPFPQ

SEQ ID NO: 1571 - protein, 16 aa, Artificial Sequence
  Description of Artificial Sequence: Synthetic gluten peptide
GFPQTQQPEQPFPQQG

SEQ ID NO: 1572 - protein, 9 aa, Artificial Sequence
  Description of Artificial Sequence: Synthetic gluten peptide
  MOD_RES (2)..(2): F or I or Y or L
  MOD_RES (3)..(3): P or S
  MOD_RES (5)..(5): Q or R
  MOD_RES (9)..(9): P or T
PXXZXPZQX

SEQ ID NO: 1573 - protein, 20 aa, Artificial Sequence
  Description of Artificial Sequence: Synthetic gluten peptide
PLQPQQPFPQQPQQPFPQPQ

SEQ ID NO: 1574 - protein, 16 aa, Artificial Sequence
  Description of Artificial Sequence: Synthetic gluten peptide
GQPFPEQPQQPFPQQG

SEQ ID NO: 1575 - protein, 9 aa, Artificial Sequence
  Description of Artificial Sequence: Synthetic gluten peptide
FLPZLPYPQ

SEQ ID NO: 1576 - protein, 20 aa, Artificial Sequence
  Description of Artificial Sequence: Synthetic gluten peptide
LQLQPFPQPQPFLPQLPYPQ

SEQ ID NO: 1577 - protein, 17 aa, Artificial Sequence
  Description of Artificial Sequence: Synthetic gluten peptide
PQPQPFLPELPYPQPQS

SEQ ID NO: 1578 - protein, 9 aa, Artificial Sequence
  Description of Artificial Sequence: Synthetic gluten peptide
LQQILZQQL

SEQ ID NO: 1579 - protein, 20 aa, Artificial Sequence
  Description of Artificial Sequence: Synthetic gluten peptide
LQQILQQQLTPCMDVVLQQH

SEQ ID NO: 1580 - protein, 11 aa, Artificial Sequence
  Description of Artificial Sequence: Synthetic gluten peptide
FSYQZQPFPQQ

SEQ ID NO: 1581 - protein, 20 aa, Artificial Sequence
  Description of Artificial Sequence: Synthetic gluten peptide
PQQSFSYQQQPFPQQPYPQQ

SEQ ID NO: 1582 - protein, 9 aa, Artificial Sequence
  Description of Artificial Sequence: Synthetic gluten peptide
  MOD_RES (5)..(5): L or Q
  MOD_RES (8)..(8): L or M
FPSZXPYXQ

SEQ ID NO: 1583 - protein, 20 aa, Artificial Sequence
  Description of Artificial Sequence: Synthetic gluten peptide
PFPSQQPYLQLQPFPQPQLP

SEQ ID NO: 1584 - protein, 9 aa, Artificial Sequence
  Description of Artificial Sequence: Synthetic gluten peptide
  MOD_RES (1)..(1): P or Q or S or H
  MOD_RES (7)..(7): L or F
  MOD_RES (8)..(8): P or S
XQPZQZXXQ

SEQ ID NO: 1585 - protein, 20 aa, Artificial Sequence
  Description of Artificial Sequence: Synthetic gluten peptide
QQPQQPFPQQPQQQFPQPQQ

SEQ ID NO: 1586 - protein, 16 aa, Artificial Sequence
  Description of Artificial Sequence: Synthetic gluten peptide
GFFPQPEQEFPQPQQG

SEQ ID NO: 1587 - protein, 9 aa, Artificial Sequence
  Description of Artificial Sequence: Synthetic gluten peptide
  MOD_RES (2)..(2): F or W
  MOD_RES (3)..(3): S or P
  MOD_RES (6)..(6): E or Q or T
  MOD_RES (9)..(9): V or I or L or S or F
PXXZQXQPX

SEQ ID NO: 1588 - protein, 20 aa, Artificial Sequence
  Description of Artificial Sequence: Synthetic gluten peptide
QQQQPPFSQQQQPVLPQQSP

SEQ ID NO: 1589 - protein, 20 aa, Artificial Sequence
  Description of Artificial Sequence: Synthetic gluten peptide
PSGQVQWPQQQQPFPQPQQP

SEQ ID NO: 1590 - protein, 16 aa, Artificial Sequence
  Description of Artificial Sequence: Synthetic gluten peptide
GQPPFSEQEQPVLPQG

SEQ ID NO: 1591 - protein, 9 aa, Artificial Sequence
  Description of Artificial Sequence: Synthetic gluten peptide
  MOD_RES (1)..(1): I or L
XQPZQPFPQ

SEQ ID NO: 1592 - protein, 20 aa, Artificial Sequence
  Description of Artificial Sequence: Synthetic gluten peptide
FTQPQQPTPIQPQQPFPQQP

SEQ ID NO: 1593 - protein, 16 aa, Artificial Sequence
  Description of Artificial Sequence: Synthetic gluten peptide
GQQQFIQPEQPFPQQG

SEQ ID NO: 1594 - protein, 9 aa, Artificial Sequence
  Description of Artificial Sequence: Synthetic gluten peptide
QQPZLPFPQ

SEQ ID NO: 1595 - protein, 20 aa, Artificial Sequence
  Description of Artificial Sequence: Synthetic gluten peptide
QQPQQPFPQPQQPQLPFPQQ

SEQ ID NO: 1596 - protein, 9 aa, Artificial Sequence
  Description of Artificial Sequence: Synthetic gluten peptide
QPQQPZLPF

SEQ ID NO: 1597 - protein, 20 aa, Artificial Sequence
  Description of Artificial Sequence: Synthetic gluten peptide
QQPQQPFPQPQQPQLPFPQQ

SEQ ID NO: 1598 - protein, 9 aa, Artificial Sequence
  Description of Artificial Sequence: Synthetic gluten peptide
PQPZQPZLP

SEQ ID NO: 1599 - protein, 20 aa, Artificial Sequence
  Description of Artificial Sequence: Synthetic gluten peptide
QQPQQPFPQPQQPQLPFPQQ

SEQ ID NO: 1600 - protein, 10 aa, Artificial Sequence
  Description of Artificial Sequence: Synthetic gluten peptide
VFLQQQCSPV

SEQ ID NO: 1601 - protein, 20 aa, Artificial Sequence
  Description of Artificial Sequence: Synthetic gluten peptide
SVLQQLNPCKVFLQQQCSHV

SEQ ID NO: 1602 - protein, 20 aa, Artificial Sequence
  Description of Artificial Sequence: Synthetic gluten peptide
CKVFLQQQCSPVAMPQRLAR

SEQ ID NO: 1603 - protein, 20 aa, Artificial Sequence
  Description of Artificial Sequence: Synthetic gluten peptide
KVFLQQQCSPVAIPYRLARS

SEQ ID NO: 1604 - protein, 11 aa, Artificial Sequence
  Description of Artificial Sequence: Synthetic gluten peptide
  MOD_RES (2)..(2): W or L
  MOD_RES (3)..(3): Q or W
MXXQSSCHVMQ

SEQ ID NO: 1605 - protein, 20 aa, Artificial Sequence
  Description of Artificial Sequence: Synthetic gluten peptide
PQRLARSQMWQQSSCHVMQQ

SEQ ID NO: 1606 - protein, 19 aa, Artificial Sequence
  Description of Artificial Sequence: Synthetic gluten peptide
ARSQTLWQSSCHVMQQCCR

SEQ ID NO: 1607 - protein, 9 aa, Artificial Sequence
  Description of Artificial Sequence: Synthetic gluten peptide
QPQQQQLAH

SEQ ID NO: 1608 - protein, 20 aa, Artificial Sequence
  Description of Artificial Sequence: Synthetic gluten peptide
QQPQQQQLAHGTFLQPHQIA

SEQ ID NO: 1609 - protein, 11 aa, Artificial Sequence
  Description of Artificial Sequence: Synthetic gluten peptide
  MOD_RES (9)..(9): F or L
FPLQPQQPXPQ

SEQ ID NO: 1610 - protein, 20 aa, Artificial Sequence
  Description of Artificial Sequence: Synthetic gluten peptide
PQQLQQPFPLQPQQPFPQQP

SEQ ID NO: 1611 - protein, 9 aa, Artificial Sequence
  Description of Artificial Sequence: Synthetic gluten peptide
  MOD_RES (5)..(5): L or Q
FPPZXPYPQ

SEQ ID NO: 1612 - protein, 20 aa, Artificial Sequence
  Description of Artificial Sequence: Synthetic gluten peptide
PQPFPPELPYPQPQPFRPQQ

SEQ ID NO: 1613 - protein, 17 aa, Artificial Sequence
  Description of Artificial Sequence: Synthetic gluten peptide
PQPQPFPPQLPYPQPQS

SEQ ID NO: 1614 - protein, 16 aa, Artificial Sequence
  Description of Artificial Sequence: Synthetic gluten peptide
GQQQPFPPEQPYPQQG

SEQ ID NO: 1615 - protein, 10 aa, Artificial Sequence
  Description of Artificial Sequence: Synthetic gluten peptide
  MOD_RES (5)..(5): H or Q or R
  MOD_RES (7)..(7): P or W
LCCZXLXZIP

SEQ ID NO: 1616 - protein, 20 aa, Artificial Sequence
  Description of Artificial Sequence: Synthetic gluten peptide
QSTYQPLQQLCCQQLWQIPE

SEQ ID NO: 1617 - protein, 9 aa, Artificial Sequence
  Description of Artificial Sequence: Synthetic gluten peptide
  MOD_RES (2)..(2): W or L or S
  MOD_RES (3)..(3): Q or L
  MOD_RES (8)..(8): P or Q
  MOD_RES (9)..(9): P or Q
PXXZQPLXX

SEQ ID NO: 1618 - protein, 20 aa, Artificial Sequence
  Description of Artificial Sequence: Synthetic gluten peptide
ERPWQEQPLPPQHTLFPQQQ

SEQ ID NO: 1619 - protein, 9 aa, Artificial Sequence
  Description of Artificial Sequence: Synthetic gluten peptide
QPLPZQPSF

SEQ ID NO: 1620 - protein, 20 aa, Artificial Sequence
  Description of Artificial Sequence: Synthetic gluten peptide
PPFSQQQQQPLPQQPSFSQQ

SEQ ID NO: 1621 - protein, 10 aa, Artificial Sequence
  Description of Artificial Sequence: Synthetic gluten peptide
  MOD_RES (3)..(3): S or P
  MOD_RES (10)..(10): L or V or I
PFXQQQQQPX

SEQ ID NO: 1622 - protein, 20 aa, Artificial Sequence
  Description of Artificial Sequence: Synthetic gluten peptide
PPFSQQQQQPLPQQPSFSQQ

SEQ ID NO: 1623 - protein, 9 aa, Artificial Sequence
  Description of Artificial Sequence: Synthetic gluten peptide
IVYSTILQE

SEQ ID NO: 1624 - protein, 20 aa, Artificial Sequence
  Description of Artificial Sequence: Synthetic gluten peptide
QQSRYEAIRAIVYSTILQEQ

SEQ ID NO: 1625 - protein, 10 aa, Artificial Sequence
  Description of Artificial Sequence: Synthetic gluten peptide
  MOD_RES (8)..(8): I or S
  MOD_RES (9)..(9): L or F
PFSQZQPXXS

SEQ ID NO: 1626 - protein, 20 aa, Artificial Sequence
  Description of Artificial Sequence: Synthetic gluten peptide
FSQQQPPFSQQQPILSQQPP

SEQ ID NO: 1627 - protein, 9 aa, Artificial Sequence
  Description of Artificial Sequence: Synthetic gluten peptide
QGIQILRPL

SEQ ID NO: 1628 - protein, 20 aa, Artificial Sequence
  Description of Artificial Sequence: Synthetic gluten peptide
QEQQQGIQILRPLFQLVQGQ

SEQ ID NO: 1629 - protein, 9 aa, Artificial Sequence
  Description of Artificial Sequence: Synthetic gluten peptide
PFSSVVAGI

SEQ ID NO: 1630 - protein, 20 aa, Artificial Sequence
  Description of Artificial Sequence: Synthetic gluten peptide
CSIIKAPFSSVVAGIGGQYR

SEQ ID NO: 1631 - protein, 9 aa, Artificial Sequence
  Description of Artificial Sequence: Synthetic gluten peptide
YCSTTIAPV

SEQ ID NO: 1632 - protein, 19 aa, Artificial Sequence
  Description of Artificial Sequence: Synthetic gluten peptide
YIPPYCSTTIAPVGIFGTN

SEQ ID NO: 1633 - protein, 9 aa, Artificial Sequence
  Description of Artificial Sequence: Synthetic gluten peptide
HVAMSQRLA

SEQ ID NO: 1634 - protein, 20 aa, Artificial Sequence
  Description of Artificial Sequence: Synthetic gluten peptide
QQCSHVAMSQRLARSQMWQQ

SEQ ID NO: 1635 - protein, 12 aa, Artificial Sequence
  Description of Artificial Sequence: Synthetic gluten peptide
YSIILQZZZQGF

SEQ ID NO: 1636 - protein, 20 aa, Artificial Sequence
  Description of Artificial Sequence: Synthetic gluten peptide
RYDAICAITYSIILQEQQQG

SEQ ID NO: 1637 - protein, 12 aa, Artificial Sequence
  Description of Artificial Sequence: Synthetic gluten peptide
FPHQPQEQAFPQ

SEQ ID NO: 1638 - protein, 20 aa, Artificial Sequence
  Description of Artificial Sequence: Synthetic gluten peptide
QQIFPQPQQTFPHQPQQAFP

SEQ ID NO: 1639 - protein, 16 aa, Artificial Sequence
  Description of Artificial Sequence: Synthetic gluten peptide
GQTFPHQPEQAFPQPG

SEQ ID NO: 1640 - protein, 9 aa, Artificial Sequence
  Description of Artificial Sequence: Synthetic gluten peptide
  MOD_RES (3)..(3): G or S
PSXZVZWPQ

SEQ ID NO: 1641 - protein, 20 aa, Artificial Sequence
  Description of Artificial Sequence: Synthetic gluten peptide
ATANMQADPSGQVQWPQQQP

SEQ ID NO: 1642 - protein, 9 aa, Artificial Sequence
  Description of Artificial Sequence: Synthetic gluten peptide
GALCSSLSN

SEQ ID NO: 1643 - protein, 20 aa, Artificial Sequence
  Description of Artificial Sequence: Synthetic gluten peptide
FDEEKNSTGALCSSLSNQAS

SEQ ID NO: 1644 - protein, 9 aa, Artificial Sequence
  Description of Artificial Sequence: Synthetic gluten peptide
QFPZQZIPV

SEQ ID NO: 1645 - protein, 20 aa, Artificial Sequence
  Description of Artificial Sequence: Synthetic gluten peptide
QPPFPQQHQQFPQQQIPVVQ

SEQ ID NO: 1646 - protein, 9 aa, Artificial Sequence
  Description of Artificial Sequence: Synthetic gluten peptide
  MOD_RES (2)..(2): F or Y
  MOD_RES (7)..(7): Y or F
PXPZQPXPQ

SEQ ID NO: 1647 - protein, 20 aa, Artificial Sequence
  Description of Artificial Sequence: Synthetic gluten peptide
QQPFPQQPYPQQPYPSQQPY

SEQ ID NO: 1648 - protein, 9 aa, Artificial Sequence
  Description of Artificial Sequence: Synthetic gluten peptide
QAGQGZZGY

SEQ ID NO: 1649 - protein, 20 aa, Artificial Sequence
  Description of Artificial Sequence: Synthetic gluten peptide
GQQAGQGQQGYYPTSPQQLG

SEQ ID NO: 1650 - protein, 9 aa, Artificial Sequence
  Description of Artificial Sequence: Synthetic gluten peptide
TLPSMCNVY

SEQ ID NO: 1651 - protein, 20 aa, Artificial Sequence
  Description of Artificial Sequence: Synthetic gluten peptide
FEEIRNLALQTLPSMCNVYI

SEQ ID NO: 1652 - protein, 9 aa, Artificial Sequence
  Description of Artificial Sequence: Synthetic gluten peptide
FQPSQZNPQ

SEQ ID NO: 1653 - protein, 20 aa, Artificial Sequence
  Description of Artificial Sequence: Synthetic gluten peptide
QQYPSGQGFFQPSQQNPQAQ

SEQ ID NO: 1654 - protein, 9 aa, Artificial Sequence
  Description of Artificial Sequence: Synthetic gluten peptide
IRSLVLKTL

SEQ ID NO: 1655 - protein, 20 aa, Artificial Sequence
  Description of Artificial Sequence: Synthetic gluten peptide
QPQQPAQLEGIRSLVLKTLP

SEQ ID NO: 1656 - protein, 17 aa, Artificial Sequence
  Description of Artificial Sequence: Synthetic gluten peptide
QLQPFPQPQLPYPQPQP

SEQ ID NO: 1657 - protein, 16 aa, Artificial Sequence
  Description of Artificial Sequence: Synthetic gluten peptide
GQQPFPQPEQPFPWQG

SEQ ID NO: 1658 - protein, 16 aa, Artificial Sequence
  Description of Artificial Sequence: Synthetic gluten peptide
GQQPFPQPEQPIPVQG

SEQ ID NO: 1659 - protein, 16 aa, Artificial Sequence
  Description of Artificial Sequence: Synthetic gluten peptide
GQQPFPQPEQPFPWQG

SEQ ID NO: 1660 - protein, 16 aa, Artificial Sequence
  Description of Artificial Sequence: Synthetic gluten peptide
GFPQTQQPEQPFPQQG

SEQ ID NO: 1661 - protein, 16 aa, Artificial Sequence
  Description of Artificial Sequence: Synthetic gluten peptide
GFPQTQQPEQPFPQQG

SEQ ID NO: 1662 - protein, 16 aa, Artificial Sequence
  Description of Artificial Sequence: Synthetic gluten peptide
GQPFPEQPQQPFPQQG

SEQ ID NO: 1663 - protein, 17 aa, Artificial Sequence
  Description of Artificial Sequence: Synthetic gluten peptide
PQPQPFLPQLPYPQPQS

SEQ ID NO: 1664 - protein, 16 aa, Artificial Sequence
  Description of Artificial Sequence: Synthetic gluten peptide
GFFPQPEQEFPQPQQG

SEQ ID NO: 1665 - protein, 16 aa, Artificial Sequence
  Description of Artificial Sequence: Synthetic gluten peptide
GFFPQPEQEFPQPQQG

SEQ ID NO: 1666 - protein, 16 aa, Artificial Sequence
  Description of Artificial Sequence: Synthetic gluten peptide
GQPPFSEQEQPVLPQG

SEQ ID NO: 1667 - protein, 16 aa, Artificial Sequence
  Description of Artificial Sequence: Synthetic gluten peptide
GQPPFSEQEQPVLPQG

SEQ ID NO: 1668 - protein, 16 aa, Artificial Sequence
  Description of Artificial Sequence: Synthetic gluten peptide
GQQQFIQPEQPFPQQG

SEQ ID NO: 1669 - protein, 17 aa, Artificial Sequence
  Description of Artificial Sequence: Synthetic gluten peptide
PQPQPFPPQLPYPQPQS

SEQ ID NO: 1670 - protein, 16 aa, Artificial Sequence
  Description of Artificial Sequence: Synthetic gluten peptide
GQQQPFPPEQPYPQQG

SEQ ID NO: 1671 - protein, 16 aa, Artificial Sequence
  Description of Artificial Sequence: Synthetic gluten peptide
GQTFPHQPEQAFPQPG

SEQ ID NO: 1672 - protein, 20 aa, Artificial Sequence
  Description of Artificial Sequence: Synthetic gluten peptide
TTTVQYDPSEQYQPYPEQQQ

SEQ ID NO: 1673 - protein, 20 aa, Artificial Sequence
  Description of Artificial Sequence: Synthetic gluten peptide
QFDPSEQYQPYPEQQQPILQ

SEQ ID NO: 1674 - protein, 20 aa, Artificial Sequence
  Description of Artificial Sequence: Synthetic gluten peptide
VQYDPSEQYQPYPEQQQPFV

SEQ ID NO: 1675 - protein, 20 aa, Artificial Sequence
  Description of Artificial Sequence: Synthetic gluten peptide
TVQYNPSEQYQPYPEQQEPF

SEQ ID NO: 1676 - protein, 20 aa, Artificial Sequence
  Description of Artificial Sequence: Synthetic gluten peptide
YQPYPEQQQPILQQQQMLLQ

SEQ ID NO: 1677 - protein, 20 aa, Artificial Sequence
  Description of Artificial Sequence: Synthetic gluten peptide
EQYQPYPEQQQPFVQQQPPF

SEQ ID NO: 1678 - protein, 20 aa, Artificial Sequence
  Description of Artificial Sequence: Synthetic gluten peptide
SEQYQPYPEQQPFMQPLLQQ

SEQ ID NO: 1679 - protein, 20 aa, Artificial Sequence
  Description of Artificial Sequence: Synthetic gluten peptide
CRRLEQIPEQLRCPAIHSVV

SEQ ID NO: 1680 - protein, 20 aa, Artificial Sequence
  Description of Artificial Sequence: Synthetic gluten peptide
QIPEQLRCPAIHSVVQAIIL

SEQ ID NO: 1681 - protein, 20 aa, Artificial Sequence
  Description of Artificial Sequence: Synthetic gluten peptide
NNKREQQFGQNIFSGFSVQL

SEQ ID NO: 1682 - protein, 20 aa, Artificial Sequence
  Description of Artificial Sequence: Synthetic gluten peptide
QILRQAICQVTRQQCCRQLA

SEQ ID NO: 1683 - protein, 20 aa, Artificial Sequence
  Description of Artificial Sequence: Synthetic gluten peptide
VPFLRSQILRQSTCHVMRRQ

SEQ ID NO: 1684 - protein, 9 aa, Artificial Sequence
  Description of Artificial Sequence: Synthetic gluten peptide
DPSEQYQPY

SEQ ID NO: 1685 - protein, 9 aa, Artificial Sequence
  Description of Artificial Sequence: Synthetic gluten peptide
PYPEQQQPI

SEQ ID NO: 1686 - protein, 10 aa, Artificial Sequence
  Description of Artificial Sequence: Synthetic gluten peptide
DPSEQYQPYP

SEQ ID NO: 1687 - protein, 9 aa, Artificial Sequence
  Description of Artificial Sequence: Synthetic gluten peptide
PYPEQQQPF

SEQ ID NO: 1688 - protein, 10 aa, Artificial Sequence
  Description of Artificial Sequence: Synthetic gluten peptide
DPSEQYQPYP

SEQ ID NO: 1689 - protein, 9 aa, Artificial Sequence
  Description of Artificial Sequence: Synthetic gluten peptide
PYPEQQEPF

SEQ ID NO: 1690 - protein, 10 aa, Artificial Sequence
  Description of Artificial Sequence: Synthetic gluten peptide
DPSEQYQPYP

SEQ ID NO: 1691 - protein, 9 aa, Artificial Sequence
  Description of Artificial Sequence: Synthetic gluten peptide
PYPEQQQPI

SEQ ID NO: 1692 - protein, 9 aa, Artificial Sequence
  Description of Artificial Sequence: Synthetic gluten peptide
PYPEQQQPF

SEQ ID NO: 1693 - protein, 9 aa, Artificial Sequence
  Description of Artificial Sequence: Synthetic gluten peptide
PYPEQQPFM

SEQ ID NO: 1694 - protein, 9 aa, Artificial Sequence
  Description of Artificial Sequence: Synthetic gluten peptide
RRLEQIPEQ

SEQ ID NO: 1695 - protein, 10 aa, Artificial Sequence
  Description of Artificial Sequence: Synthetic gluten peptide
  MOD_RES (9)..(9): I or F
  MOD_RES (10)..(10): V or L or M
PYPEQZQPXX

SEQ ID NO: 1696 - protein, 20 aa, Artificial Sequence
  Description of Artificial Sequence: Synthetic gluten peptide
QFDPSEQYQPYPEQQQPILQ

SEQ ID NO: 1697 - protein, 20 aa, Artificial Sequence
  Description of Artificial Sequence: Synthetic gluten peptide
CRRLEQIPEQLRCPAIHSVV

SEQ ID NO: 1698 - protein, 20 aa, Artificial Sequence
  Description of Artificial Sequence: Synthetic gluten peptide
QFGQNIFSGFSVQLLSEALG

SEQ ID NO: 1699 - protein, 9 aa, Artificial Sequence
  Description of Artificial Sequence: Synthetic gluten peptide
QQPTPIQPQ

SEQ ID NO: 1700 - protein, 9 aa, Artificial Sequence
  Description of Artificial Sequence: Synthetic gluten peptide
QQPFPQQPQ

SEQ ID NO: 1701 - protein, 9 aa, Artificial Sequence
  Description of Artificial Sequence: Synthetic gluten peptide
QQPFPWQPQ

SEQ ID NO: 1702 - protein, 9 aa, Artificial Sequence
  Description of Artificial Sequence: Synthetic gluten peptide
QQPFPQSQQ

SEQ ID NO: 1703 - protein, 9 aa, Artificial Sequence
  Description of Artificial Sequence: Synthetic gluten peptide
QQPFPLQPQ

SEQ ID NO: 1704 - protein, 9 aa, Artificial Sequence
  Description of Artificial Sequence: Synthetic gluten peptide
QQPFPQLQQ

SEQ ID NO: 1705 - protein, 9 aa, Artificial Sequence
  Description of Artificial Sequence: Synthetic gluten peptide
QQPIPVQPQ

SEQ ID NO: 1706 - protein, 9 aa, Artificial Sequence
  Description of Artificial Sequence: Synthetic gluten peptide
QQPIPQQPQ

SEQ ID NO: 1707 - protein, 9 aa, Artificial Sequence
  Description of Artificial Sequence: Synthetic gluten peptide
QQPYPQQPQ

SEQ ID NO: 1708 - protein, 12 aa, Artificial Sequence
  Description of Artificial Sequence: Synthetic gluten peptide
PQQPQQSFPQQQ

SEQ ID NO: 1709 - protein, 12 aa, Artificial Sequence
  Description of Artificial Sequence: Synthetic gluten peptide
PQQPQQPFPQQQ

SEQ ID NO: 1710 - protein, 9 aa, Artificial Sequence
  Description of Artificial Sequence: Synthetic gluten peptide
QGSFQPSQQ

SEQ ID NO: 1711 - protein, 10 aa, Artificial Sequence
  Description of Artificial Sequence: Synthetic gluten peptide
PQQPFPQPQQ

SEQ ID NO: 1712 - protein, 10 aa, Artificial Sequence
  Description of Artificial Sequence: Synthetic gluten peptide
PQQPFPQTQQ

SEQ ID NO: 1713 - protein, 9 aa, Artificial Sequence
  Description of Artificial Sequence: Synthetic gluten peptide
QQPQQPFPQ

SEQ ID NO: 1714 - protein, 9 aa, Artificial Sequence
  Description of Artificial Sequence: Synthetic gluten peptide
QQPQQPYPQ

SEQ ID NO: 1715 - protein, 9 aa, Artificial Sequence
  Description of Artificial Sequence: Synthetic gluten peptide
PFPQPQQPQ

SEQ ID NO: 1716 - protein, 9 aa, Artificial Sequence
  Description of Artificial Sequence: Synthetic gluten peptide
PFPQSQQPQ

SEQ ID NO: 1717 - protein, 9 aa, Artificial Sequence
  Description of Artificial Sequence: Synthetic gluten peptide
PFPQPQQAQ

SEQ ID NO: 1718 - protein, 9 aa, Artificial Sequence
  Description of Artificial Sequence: Synthetic gluten peptide
QFPQTQQPQ

SEQ ID NO: 1719 - protein, 9 aa, Artificial Sequence
  Description of Artificial Sequence: Synthetic gluten peptide
PQQQFIQPQ

SEQ ID NO: 1720 - protein, 9 aa, Artificial Sequence
  Description of Artificial Sequence: Synthetic gluten peptide
QQPQLPFPQ

SEQ ID NO: 1721 - protein, 9 aa, Artificial Sequence
  Description of Artificial Sequence: Synthetic gluten peptide
LQPQQPFPQ

SEQ ID NO: 1722 - protein, 20 aa, Artificial Sequence
  Description of Artificial Sequence: Synthetic gluten peptide
PFTQPQQPTPIQPQQPFPQQ

SEQ ID NO: 1723 - protein, 20 aa, Artificial Sequence
  Description of Artificial Sequence: Synthetic gluten peptide
QQQFIQPQQPFPQQPQQTYP

SEQ ID NO: 1724 - protein, 20 aa, Artificial Sequence
  Description of Artificial Sequence: Synthetic gluten peptide
PFPQQPQQPFPQQPQQSFPQ

SEQ ID NO: 1725 - protein, 20 aa, Artificial Sequence
  Description of Artificial Sequence: Synthetic gluten peptide
TPIQPQQPFPQQPQQPQQPF

SEQ ID NO: 1726 - protein, 20 aa, Artificial Sequence
  Description of Artificial Sequence: Synthetic gluten peptide
QTQQPQQPFPQQPQQPFPQT

SEQ ID NO: 1727 - protein, 20 aa, Artificial Sequence
  Description of Artificial Sequence: Synthetic gluten peptide
QQFLQPQQPFPQQPQQPYPQ

SEQ ID NO: 1728 - protein, 20 aa, Artificial Sequence
  Description of Artificial Sequence: Synthetic gluten peptide
PQQPFPQQPQQPQQPFPQPQ

SEQ ID NO: 1729 - protein, 20 aa, Artificial Sequence
  Description of Artificial Sequence: Synthetic gluten peptide
QQPFPQQPQQPFPQPQQPIP

SEQ ID NO: 1730 - protein, 20 aa, Artificial Sequence
  Description of Artificial Sequence: Synthetic gluten peptide
PQQPFLQPQQPFPQQPQQPF

SEQ ID NO: 1731 - protein, 20 aa, Artificial Sequence
  Description of Artificial Sequence: Synthetic gluten peptide
QPFPQPQQPFPWQPQQPFPQ

SEQ ID NO: 1732 - protein, 20 aa, Artificial Sequence
  Description of Artificial Sequence: Synthetic gluten peptide
QPQQPFPQSQQPQQPFPQPQ

SEQ ID NO: 1733 - protein, 20 aa, Artificial Sequence
  Description of Artificial Sequence: Synthetic gluten peptide
PQTQQPQQPFPQSQQPQQPF

SEQ ID NO: 1734 - protein, 20 aa, Artificial Sequence
  Description of Artificial Sequence: Synthetic gluten peptide
SEQIIPQQLQQPFPLQPQQP

SEQ ID NO: 1735 - protein, 20 aa, Artificial Sequence
  Description of Artificial Sequence: Synthetic gluten peptide
PFPQTQQPQQPFPQLQQPQQ

SEQ ID NO: 1736 - protein, 20 aa, Artificial Sequence
  Description of Artificial Sequence: Synthetic gluten peptide
QPQQPIPVQPQQSFPQQSQQ

SEQ ID NO: 1737 - protein, 20 aa, Artificial Sequence
  Description of Artificial Sequence: Synthetic gluten peptide
FPELQQPIPQQPQQPFPLQP

SEQ ID NO: 1738 - protein, 20 aa, Artificial Sequence
  Description of Artificial Sequence: Synthetic gluten peptide
FPQQPQQPYPQQPQQPFPQT

SEQ ID NO: 1739 - protein, 20 aa, Artificial Sequence
  Description of Artificial Sequence: Synthetic gluten peptide
PRQPFPQQPQQPYPQQPQQP

SEQ ID NO: 1740 - protein, 20 aa, Artificial Sequence
  Description of Artificial Sequence: Synthetic gluten peptide
PFPQPQQPQQSFPQQQQPLI

SEQ ID NO: 1741 - protein, 20 aa, Artificial Sequence
  Description of Artificial Sequence: Synthetic gluten peptide
LPQPQQPQQSFPQQQRPFIQ

SEQ ID NO: 1742 - protein, 20 aa, Artificial Sequence
  Description of Artificial Sequence: Synthetic gluten peptide
QPQQPQQPFPQQQQPLIQPY

SEQ ID NO: 1743 - protein, 20 aa, Artificial Sequence
  Description of Artificial Sequence: Synthetic gluten peptide
QPQQQYPSGQGSFQPSQQNP

SEQ ID NO: 1744 - protein, 20 aa, Artificial Sequence
  Description of Artificial Sequence: Synthetic gluten peptide
QYPSSQGSFQPSQQNPQAQG

SEQ ID NO: 1745 - protein, 20 aa, Artificial Sequence
  Description of Artificial Sequence: Synthetic gluten peptide
GQGFFQPSQQNPQAQGSFQP

SEQ ID NO: 1746 - protein, 20 aa, Artificial Sequence
  Description of Artificial Sequence: Synthetic gluten peptide
PQTQQPQQPFPQPQQTFPQQ

SEQ ID NO: 1747 - protein, 20 aa, Artificial Sequence
  Description of Artificial Sequence: Synthetic gluten peptide
QQPQQPFPQPQLPFPQQSEQ

SEQ ID NO: 1748 - protein, 20 aa, Artificial Sequence
  Description of Artificial Sequence: Synthetic gluten peptide
FPWQPQQPFPQTQQSFPLQP

SEQ ID NO: 1749 - protein, 20 aa, Artificial Sequence
  Description of Artificial Sequence: Synthetic gluten peptide
PFPQTQQPQQPFPQLQQPQQ

SEQ ID NO: 1750 - protein, 20 aa, Artificial Sequence
  Description of Artificial Sequence: Synthetic gluten peptide
QQPLPQPQQPQQPFPQSQQP

SEQ ID NO: 1751 - protein, 20 aa, Artificial Sequence
  Description of Artificial Sequence: Synthetic gluten peptide
PFPQLQQPQQPFPQPQQQLP

SEQ ID NO: 1752 - protein, 20 aa, Artificial Sequence
  Description of Artificial Sequence: Synthetic gluten peptide
PRQPFPQQPQQPYPQQPQQP

SEQ ID NO: 1753 - protein, 20 aa, Artificial Sequence
  Description of Artificial Sequence: Synthetic gluten peptide
PQQPFPQPQQPQQPFPQLQQ

SEQ ID NO: 1754 - protein, 20 aa, Artificial Sequence
  Description of Artificial Sequence: Synthetic gluten peptide
PQTQQPQQPFPQSQQPQQPF

SEQ ID NO: 1755 - protein, 20 aa, Artificial Sequence
  Description of Artificial Sequence: Synthetic gluten peptide
QPQQPFPQSQQPQQPFPQPQ

SEQ ID NO: 1756 - protein, 20 aa, Artificial Sequence
  Description of Artificial Sequence: Synthetic gluten peptide
PQQPQQPFPQPQQAQLPFPQ

SEQ ID NO: 1757 - protein, 20 aa, Artificial Sequence
  Description of Artificial Sequence: Synthetic gluten peptide
HQPQQQFPQTQQPQQPFPQP

SEQ ID NO: 1758 - protein, 20 aa, Artificial Sequence
  Description of Artificial Sequence: Synthetic gluten peptide
FSQPQQPQQQFIQPQQPFPQ

SEQ ID NO: 1759 - protein, 20 aa, Artificial Sequence
  Description of Artificial Sequence: Synthetic gluten peptide
PQPQQPQLPFPQQPQQPFPQ

SEQ ID NO: 1760 - protein, 20 aa, Artificial Sequence
  Description of Artificial Sequence: Synthetic gluten peptide
PQQQFLQPQQPFPQQPRQPY

SEQ ID NO: 1761 - protein, 20 aa, Artificial Sequence
  Description of Artificial Sequence: Synthetic gluten peptide
QTLPAMCNVYIPPHCSTTIA

SEQ ID NO: 1762 - protein, 20 aa, Artificial Sequence
  Description of Artificial Sequence: Synthetic gluten peptide
NPSQQQPQEQVPLVQEQQFQ

SEQ ID NO: 1763 - protein, 20 aa, Artificial Sequence
  Description of Artificial Sequence: Synthetic gluten peptide
HHFRSNSNHHFHSNNNQFYR

SEQ ID NO: 1764 - protein, 16 aa, Artificial Sequence
  Description of Artificial Sequence: Synthetic gluten peptide
EQQFGQNIFSGFSVQL

SEQ ID NO: 1765 - protein, 16 aa, Artificial Sequence
  Description of Artificial Sequence: Synthetic gluten peptide
QLRCPAIHSVVQAIIL

SEQ ID NO: 1766 - protein, 16 aa, Artificial Sequence
  Description of Artificial Sequence: Synthetic gluten peptide
QYQPYPEQEQPILQQQ

SEQ ID NO: 1767 - protein, 16 aa, Artificial Sequence
  Description of Artificial Sequence: Synthetic gluten peptide
QIPEQLRCPAIHSVVQ

SEQ ID NO: 1768 - protein, 14 aa, Artificial Sequence
  Description of Artificial Sequence: Synthetic gluten peptide
EQYQPEQQPFMQPL

SEQ ID NO: 1769 - protein, 20 aa, Artificial Sequence
  Description of Artificial Sequence: Synthetic gluten peptide
PQQLFPLPQQPFPQPQQPFP

SEQ ID NO: 1770 - protein, 20 aa, Artificial Sequence
  Description of Artificial Sequence: Synthetic gluten peptide
QPFPQPQQPTPIQPQQPFPQ

SEQ ID NO: 1771 - protein, 20 aa, Artificial Sequence
  Description of Artificial Sequence: Synthetic gluten peptide
QQPQQLFPQTQQSSPQQPQQ

SEQ ID NO: 1772 - protein, 20 aa, Artificial Sequence
  Description of Artificial Sequence: Synthetic gluten peptide
PQTQQPQQPFPQPQQPQQLF

SEQ ID NO: 1773 - protein, 20 aa, Artificial Sequence
  Description of Artificial Sequence: Synthetic gluten peptide
QEQREGVQILLPQSHQQLVG

SEQ ID NO: 1774 - protein, 20 aa, Artificial Sequence
  Description of Artificial Sequence: Synthetic gluten peptide
FPQQPQQPFPQPQQQLPLQP

SEQ ID NO: 1775 - protein, 20 aa, Artificial Sequence
  Description of Artificial Sequence: Synthetic gluten peptide
PQQPFPQQPEQIIPQQPQQP

SEQ ID NO: 1776 - protein, 20 aa, Artificial Sequence
  Description of Artificial Sequence: Synthetic gluten peptide
QQLPLQPQQPFPQPQQPIPQ

SEQ ID NO: 1777 - protein, 20 aa, Artificial Sequence
  Description of Artificial Sequence: Synthetic gluten peptide
QQPQQPFPLQPQQPVPQQPQ

SEQ ID NO: 1778 - protein, 20 aa, Artificial Sequence
  Description of Artificial Sequence: Synthetic gluten peptide
SIPQPQQPFPQPQQPFPQSQ

SEQ ID NO: 1779 - protein, 20 aa, Artificial Sequence
  Description of Artificial Sequence: Synthetic gluten peptide
QTQQSIPQPQQPFPQPQQPF

SEQ ID NO: 1780 - protein, 20 aa, Artificial Sequence
  Description of Artificial Sequence: Synthetic gluten peptide
NMQVGPSGQVEWPQQQPLPQ

SEQ ID NO: 1781 - protein, 20 aa, Artificial Sequence
  Description of Artificial Sequence: Synthetic gluten peptide
VGPSGQVSWPQQQPLPQPQQ

SEQ ID NO: 1782 - protein, 20 aa, Artificial Sequence
  Description of Artificial Sequence: Synthetic gluten peptide
QQPFLLQPQQPFSQPQQPFL

SEQ ID NO: 1783 - protein, 20 aa, Artificial Sequence
  Description of Artificial Sequence: Synthetic gluten peptide
FPLQPQQPFPQQPEQIISQQ

SEQ ID NO: 1784 - protein, 20 aa, Artificial Sequence
  Description of Artificial Sequence: Synthetic gluten peptide
PQQPQRPFAQQPEQIISQQP

SEQ ID NO: 1785 - protein, 20 aa, Artificial Sequence
  Description of Artificial Sequence: Synthetic gluten peptide
SPQQPQLPFPQPQQPFVVVV

SEQ ID NO: 1786 - protein, 20 aa, Artificial Sequence
  Description of Artificial Sequence: Synthetic gluten peptide
QQPSIQLSLQQQLNPCKNVL

SEQ ID NO: 1787 - protein, 11 aa, Artificial Sequence
  Description of Artificial Sequence: Synthetic gluten peptide
QQPIPQQPQPY

SEQ ID NO: 1788 - protein, 11 aa, Artificial Sequence
  Description of Artificial Sequence: Synthetic gluten peptide
PFPQPQQPFPW

SEQ ID NO: 1789 - protein, 9 aa, Artificial Sequence
  Description of Artificial Sequence: Synthetic gluten peptide
LQPQQPFPQ

SEQ ID NO: 1790 - protein, 9 aa, Artificial Sequence
  Description of Artificial Sequence: Synthetic gluten peptide
PQPQQASPL

SEQ ID NO: 1791 - protein, 10 aa, Artificial Sequence
  Description of Artificial Sequence: Synthetic gluten peptide
IIPQQPQQPF

SEQ ID NO: 1792 - protein, 9 aa, Artificial Sequence
  Description of Artificial Sequence: Synthetic gluten peptide
YPEQPQQPF

SEQ ID NO: 1793 - protein, 20 aa, Artificial Sequence
  Description of Artificial Sequence: Synthetic gluten peptide
QQQPFPQQPIPQQPQPYPQQ

SEQ ID NO: 1794 - protein, 20 aa, Artificial Sequence
  Description of Artificial Sequence: Synthetic gluten peptide
QQPQPFSQQPIPQQPQPYPQ

SEQ ID NO: 1795 - protein, 20 aa, Artificial Sequence
  Description of Artificial Sequence: Synthetic gluten peptide
PQQPVPQQPQPYPQQPQPFP

SEQ ID NO: 1796 - protein, 20 aa, Artificial Sequence
  Description of Artificial Sequence: Synthetic gluten peptide
PQPFPQQPIPQQPQPYPQQP

SEQ ID NO: 1797 - protein, 20 aa, Artificial Sequence
  Description of Artificial Sequence: Synthetic gluten peptide
YPQQPQPFPQQPIPQQPQPY

SEQ ID NO: 1798 - protein, 20 aa, Artificial Sequence
  Description of Artificial Sequence: Synthetic gluten peptide
QPQPYPQQPQPYPQQPFQPQ

SEQ ID NO: 1799 - protein, 20 aa, Artificial Sequence
  Description of Artificial Sequence: Synthetic gluten peptide
QPQQPQPFPQQPVPQQPQPY

SEQ ID NO: 1800 - protein, 20 aa, Artificial Sequence
  Description of Artificial Sequence: Synthetic gluten peptide
PQPYPQQPQPFPQQPPFCQQ

SEQ ID NO: 1801 - protein, 20 aa, Artificial Sequence
  Description of Artificial Sequence: Synthetic gluten peptide
QPFPQPQQPFPWQPQQPFPQ

SEQ ID NO: 1802 - protein, 20 aa, Artificial Sequence
  Description of Artificial Sequence: Synthetic gluten peptide
PFPQQPQQPFPQPQQPFRQQ

SEQ ID NO: 1803 - protein, 20 aa, Artificial Sequence
  Description of Artificial Sequence: Synthetic gluten peptide
WQPQQPFPQPQQPFPLQPQQ

SEQ ID NO: 1804 - protein, 20 aa, Artificial Sequence
  Description of Artificial Sequence: Synthetic gluten peptide
PWQPQQPFPQPQEPIPQQPQ

SEQ ID NO: 1805 - protein, 20 aa, Artificial Sequence
  Description of Artificial Sequence: Synthetic gluten peptide
QQPFPQPQQPIPYQPQQPFN

SEQ ID NO: 1806 - protein, 20 aa, Artificial Sequence
  Description of Artificial Sequence: Synthetic gluten peptide
PQQPQQPFPQPQQPFSWQPQ

SEQ ID NO: 1807 - protein, 20 aa, Artificial Sequence
  Description of Artificial Sequence: Synthetic gluten peptide
QPQQPFPQPQQPIPYQPQQP

SEQ ID NO: 1808 - protein, 20 aa, Artificial Sequence
  Description of Artificial Sequence: Synthetic gluten peptide
QSQQQFPQPQQPFPQQPQQP

SEQ ID NO: 1809 - protein, 20 aa, Artificial Sequence
  Description of Artificial Sequence: Synthetic gluten peptide
PFPQPQQPFSWQPQQPFLQP

SEQ ID NO: 1810 - protein, 20 aa, Artificial Sequence
  Description of Artificial Sequence: Synthetic gluten peptide
FPQPQEPFPQQPQQPFPLQP

SEQ ID NO: 1811 - protein, 20 aa, Artificial Sequence
  Description of Artificial Sequence: Synthetic gluten peptide
PFPQPQQPFPWQPQQPFPQP

SEQ ID NO: 1812 - protein, 20 aa, Artificial Sequence
  Description of Artificial Sequence: Synthetic gluten peptide
FPQYQIPTPLQPQQPFPQQP

SEQ ID NO: 1813 - protein, 20 aa, Artificial Sequence
  Description of Artificial Sequence: Synthetic gluten peptide
FPLQPQQPFPQQPQQPFPQQ

SEQ ID NO: 1814 - protein, 20 aa, Artificial Sequence
  Description of Artificial Sequence: Synthetic gluten peptide
QQPFPLQPQQPFPQPQPFPQ

SEQ ID NO: 1815 - protein, 20 aa, Artificial Sequence
  Description of Artificial Sequence: Synthetic gluten peptide
SPLQPQQPFPQGSEQIIPQQ

SEQ ID NO: 1816 - protein, 20 aa, Artificial Sequence
  Description of Artificial Sequence: Synthetic gluten peptide
PQQASPLQPQPQQASPLQPQ

SEQ ID NO: 1817 - protein, 20 aa, Artificial Sequence
  Description of Artificial Sequence: Synthetic gluten peptide
PQQPPFWPQQPFPQQPPFGL

SEQ ID NO: 1818 - protein, 20 aa, Artificial Sequence
  Description of Artificial Sequence: Synthetic gluten peptide
PVLSQQQPCTQDQTPLLQEQ

SEQ ID NO: 1819 - protein, 20 aa, Artificial Sequence
  Description of Artificial Sequence: Synthetic gluten peptide
RQLPKYIIPQQPQQPFLLQP

SEQ ID NO: 1820 - protein, 20 aa, Artificial Sequence
  Description of Artificial Sequence: Synthetic gluten peptide
QGSEQIIPQQPQQPFPLQPH

SEQ ID NO: 1821 - protein, 20 aa, Artificial Sequence
  Description of Artificial Sequence: Synthetic gluten peptide
PQGSEQIIPQQPFPLQPQPF

SEQ ID NO: 1822 - protein, 20 aa, Artificial Sequence
  Description of Artificial Sequence: Synthetic gluten peptide
QPFPTPQQFFPYLPQQTFPP

SEQ ID NO: 1823 - protein, 20 aa, Artificial Sequence
  Description of Artificial Sequence: Synthetic gluten peptide
PFPQPPQQKYPEQPQQPFPW

SEQ ID NO: 1824 - protein, 20 aa, Artificial Sequence
  Description of Artificial Sequence: Synthetic gluten peptide
QKYPEQPQQPFPWQQPTIQL

SEQ ID NO: 1825 - protein, 20 aa, Artificial Sequence
  Description of Artificial Sequence: Synthetic gluten peptide
FQQPQQSYPVQPQQPFPQPQ

SEQ ID NO: 1826 - protein, 20 aa, Artificial Sequence
  Description of Artificial Sequence: Synthetic gluten peptide
QIPYVHPSILQQLNPCKVFL

SEQ ID NO: 1827 - protein, 20 aa, Artificial Sequence
  Description of Artificial Sequence: Synthetic gluten peptide
LAAQLPAMCRLEGGGGLLAS

SEQ ID NO: 1828 - protein, 20 aa, Artificial Sequence
  Description of Artificial Sequence: Synthetic gluten peptide
PYLPEELSPQYQIPTPLQPQ

SEQ ID NO: 1829 - protein, 20 aa, Artificial Sequence
  Description of Artificial Sequence: Synthetic gluten peptide
VSPHPGQQTTVSPHQGQQTT

SEQ ID NO: 1830 - protein, 16 aa, Artificial Sequence
  Description of Artificial Sequence: Synthetic gluten peptide
GQLPYPQPQLPYPQPG

SEQ ID NO: 1831 - protein, 16 aa, Artificial Sequence
  Description of Artificial Sequence: Synthetic gluten peptide
GLQPFPQPQLPYPQPG

SEQ ID NO: 1832 - protein, 16 aa, Artificial Sequence
  Description of Artificial Sequence: Synthetic gluten peptide
GLQPFPQPQLPFPQPG

SEQ ID NO: 1833 - protein, 16 aa, Artificial Sequence
  Description of Artificial Sequence: Synthetic gluten peptide
GLQPFPQPQLPYLQPG

SEQ ID NO: 1834 - protein, 16 aa, Artificial Sequence
  Description of Artificial Sequence: Synthetic gluten peptide
GLQPFPQPQLPYSQPG

SEQ ID NO: 1835 - protein, 16 aa, Artificial Sequence
  Description of Artificial Sequence: Synthetic gluten peptide
GLQPFPQPQLSYSQPG

SEQ ID NO: 1836 - protein, 16 aa, Artificial Sequence
  Description of Artificial Sequence: Synthetic gluten peptide
GQQPFPQPQQPFPWQG

SEQ ID NO: 1837 - protein, 16 aa, Artificial Sequence
  Description of Artificial Sequence: Synthetic gluten peptide
GQQPFPQPQQPIPVQG

SEQ ID NO: 1838 - protein, 16 aa, Artificial Sequence
  Description of Artificial Sequence: Synthetic gluten peptide
GQQPFPQPQQPFSQQG

SEQ ID NO: 1839 - protein, 16 aa, Artificial Sequence
  Description of Artificial Sequence: Synthetic gluten peptide
GQQPFPQPQQPFCQQG

SEQ ID NO: 1840 - protein, 16 aa, Artificial Sequence
  Description of Artificial Sequence: Synthetic gluten peptide
GGLERPWQQQPLPPQG

SEQ ID NO: 1841 - protein, 16 aa, Artificial Sequence
  Description of Artificial Sequence: Synthetic gluten peptide
GQTFPHQPQQAFPQPG

SEQ ID NO: 1842 - protein, 16 aa, Artificial Sequence
  Description of Artificial Sequence: Synthetic gluten peptide
LQQQCSPVAMPQRLAR

SEQ ID NO: 1843 - protein, 16 aa, Artificial Sequence
  Description of Artificial Sequence: Synthetic gluten peptide
QGQQGYYPISPQQSGQ

SEQ ID NO: 1844 - protein, 16 aa, Artificial Sequence
  Description of Artificial Sequence: Synthetic gluten peptide
PGQGQSGYYPTSPQQS

SEQ ID NO: 1845 - protein, 16 aa, Artificial Sequence
  Description of Artificial Sequence: Synthetic gluten peptide
QGQPGYYPTSPQQIGQ

SEQ ID NO: 1846 - protein, 16 aa, Artificial Sequence
  Description of Artificial Sequence: Synthetic gluten peptide
GQGQSGYYPTSPQQSG

SEQ ID NO: 1847 - protein, 16 aa, Artificial Sequence
  Description of Artificial Sequence: Synthetic gluten peptide
QQGYYPTSPQQSGQGQ

SEQ ID NO: 1848 - protein, 16 aa, Artificial Sequence
  Description of Artificial Sequence: Synthetic gluten peptide
QGQQGYYPTSPQQPPQ

SEQ ID NO: 1849 - protein, 16 aa, Artificial Sequence
  Description of Artificial Sequence: Synthetic gluten peptide
QQGYYPISPQQLGQGQ

SEQ ID NO: 1850 - protein, 16 aa, Artificial Sequence
  Description of Artificial Sequence: Synthetic gluten peptide
YVPPDCSTINVPYANI

SEQ ID NO: 1851 - protein, 16 aa, Artificial Sequence
  Description of Artificial Sequence: Synthetic gluten peptide
IIMQQEQQEQRQGVQI

SEQ ID NO: 1852 - protein, 16 aa, Artificial Sequence
  Description of Artificial Sequence: Synthetic gluten peptide
VAHAIIMHQQQQQQQE

SEQ ID NO: 1853 - protein, 16 aa, Artificial Sequence
  Description of Artificial Sequence: Synthetic gluten peptide
GQPIPQQPQQPFPLQG

SEQ ID NO: 1854 - protein, 16 aa, Artificial Sequence
  Description of Artificial Sequence: Synthetic gluten peptide
GFPQLQQPQQPFPQQG

SEQ ID NO: 1855 - protein, 16 aa, Artificial Sequence
  Description of Artificial Sequence: Synthetic gluten peptide
GFPQTQQPQQPFPQQG

SEQ ID NO: 1856 - protein, 16 aa, Artificial Sequence
  Description of Artificial Sequence: Synthetic gluten peptide
GQPLSQQPQQTFPQQG

SEQ ID NO: 1857 - protein, 16 aa, Artificial Sequence
  Description of Artificial Sequence: Synthetic gluten peptide
GQQPQQQPQQPFPQQG

SEQ ID NO: 1858 - protein, 16 aa, Artificial Sequence
  Description of Artificial Sequence: Synthetic gluten peptide
GFPQPQQPQQPFPQQG

SEQ ID NO: 1859 - protein, 16 aa, Artificial Sequence
  Description of Artificial Sequence: Synthetic gluten peptide
GFPQPQQPQQSFPQQG

SEQ ID NO: 1860 - protein, 16 aa, Artificial Sequence
  Description of Artificial Sequence: Synthetic gluten peptide
GQPQQTFPQQPQLPFG

SEQ ID NO: 1861 - protein, 16 aa, Artificial Sequence
  Description of Artificial Sequence: Synthetic gluten peptide
GMQVDPSGQVQWPQQG

SEQ ID NO: 1862 - protein, 16 aa, Artificial Sequence
  Description of Artificial Sequence: Synthetic gluten peptide
GIQVDPSGQVQWPQQG

SEQ ID NO: 1863 - protein, 16 aa, Artificial Sequence
  Description of Artificial Sequence: Synthetic gluten peptide
GMQADPSGQVQWPQQG

SEQ ID NO: 1864 - protein, 16 aa, Artificial Sequence
  Description of Artificial Sequence: Synthetic gluten peptide
GMQVDPSSQVQWPQQG

SEQ ID NO: 1865 - protein, 16 aa, Artificial Sequence
  Description of Artificial Sequence: Synthetic gluten peptide
GQQEQQILQQILQQQG

SEQ ID NO: 1866 - protein, 16 aa, Artificial Sequence
  Description of Artificial Sequence: Synthetic gluten peptide
VPLYRTTTSVPFGVGT

SEQ ID NO: 1867 - protein, 16 aa, Artificial Sequence
  Description of Artificial Sequence: Synthetic gluten peptide
LQTLPSMCNVYIPPYC

SEQ ID NO: 1868 - protein, 16 aa, Artificial Sequence
  Description of Artificial Sequence: Synthetic gluten peptide
LALQTLPAMCNVYIPP

SEQ ID NO: 1869 - protein, 16 aa, Artificial Sequence
  Description of Artificial Sequence: Synthetic gluten peptide
DAIRAIIYSIVLQEQQ

SEQ ID NO: 1870 - protein, 16 aa, Artificial Sequence
  Description of Artificial Sequence: Synthetic gluten peptide
GQQQFSQPQQQFPQPG

SEQ ID NO: 1871 - protein, 16 aa, Artificial Sequence
  Description of Artificial Sequence: Synthetic gluten peptide
GFFPQPQQQFPQPQQG

SEQ ID NO: 1872 - protein, 16 aa, Artificial Sequence
  Description of Artificial Sequence: Synthetic gluten peptide
GFPQQPQQQFPQPQQG

SEQ ID NO: 1873 - protein, 16 aa, Artificial Sequence
  Description of Artificial Sequence: Synthetic gluten peptide
GQQPFPQPQQQFPQPG

SEQ ID NO: 1874 - protein, 16 aa, Artificial Sequence
  Description of Artificial Sequence: Synthetic gluten peptide
GQPQPFLPQLPYPQPG

SEQ ID NO: 1875 - protein, 16 aa, Artificial Sequence
  Description of Artificial Sequence: Synthetic gluten peptide
GQQPFPQPQQQLPQPG

SEQ ID NO: 1876 - protein, 16 aa, Artificial Sequence
  Description of Artificial Sequence: Synthetic gluten peptide
GLPFPQQPQQPLPQPG

SEQ ID NO: 1877 - protein, 16 aa, Artificial Sequence
  Description of Artificial Sequence: Synthetic gluten peptide
GQQAFPQPQQTFPHQG

SEQ ID NO: 1878 - protein, 16 aa, Artificial Sequence
  Description of Artificial Sequence: Synthetic gluten peptide
GQQPFTQPQQPTPIQG

SEQ ID NO: 1879 - protein, 16 aa, Artificial Sequence
  Description of Artificial Sequence: Synthetic gluten peptide
GQQIFPQPQQTFPHQG

SEQ ID NO: 1880 - protein, 16 aa, Artificial Sequence
  Description of Artificial Sequence: Synthetic gluten peptide
GQQQFIQPQQPFPQQG

SEQ ID NO: 1881 - protein, 16 aa, Artificial Sequence
  Description of Artificial Sequence: Synthetic gluten peptide
GQPFPLQPQQPFPQQG

SEQ ID NO: 1882 - protein, 16 aa, Artificial Sequence
  Description of Artificial Sequence: Synthetic gluten peptide
GQPFPWQPQQPFPQQG

SEQ ID NO: 1883 - protein, 16 aa, Artificial Sequence
  Description of Artificial Sequence: Synthetic gluten peptide
GQPTPIQPQQPFPQQG

SEQ ID NO: 1884 - protein, 16 aa, Artificial Sequence
  Description of Artificial Sequence: Synthetic gluten peptide
GQVSFQQPQQQYPSPG

SEQ ID NO: 1885 - protein, 16 aa, Artificial Sequence
  Description of Artificial Sequence: Synthetic gluten peptide
GFFQQPQQQYPSSQQG

SEQ ID NO: 1886 - protein, 16 aa, Artificial Sequence
  Description of Artificial Sequence: Synthetic gluten peptide
GGKSQVLQQSTYQLLG

SEQ ID NO: 1887 - protein, 16 aa, Artificial Sequence
  Description of Artificial Sequence: Synthetic gluten peptide
GQVVNNHGQTVFNDIG

SEQ ID NO: 1888 - protein, 16 aa, Artificial Sequence
  Description of Artificial Sequence: Synthetic gluten peptide
GQPQLPFPQQPQQQFG

SEQ ID NO: 1889 - protein, 16 aa, Artificial Sequence
  Description of Artificial Sequence: Synthetic gluten peptide
GQPFPQPQQAQLPFPG

SEQ ID NO: 1890 - protein, 16 aa, Artificial Sequence
  Description of Artificial Sequence: Synthetic gluten peptide
GHQQPGQRQQGYYPTG

SEQ ID NO: 1891 - protein, 16 aa, Artificial Sequence
  Description of Artificial Sequence: Synthetic gluten peptide
GHQQFPQQQIPVVQPG

SEQ ID NO: 1892 - protein, 16 aa, Artificial Sequence
  Description of Artificial Sequence: Synthetic gluten peptide
LEAVTSIALRTLPTMC

SEQ ID NO: 1893 - protein, 16 aa, Artificial Sequence
  Description of Artificial Sequence: Synthetic gluten peptide
GQQPQFSQQQQIPVIG

SEQ ID NO: 1894 - protein, 11 aa, Artificial Sequence
  Description of Artificial Sequence: Synthetic gluten peptide
PFPQPQQPFPW

SEQ ID NO: 1895 - protein, 12 aa, Artificial Sequence
  Description of Artificial Sequence: Synthetic gluten peptide
PFPQQPQQPFPQ

SEQ ID NO: 1896 - protein, 13 aa, Artificial Sequence
  Description of Artificial Sequence: Synthetic gluten peptide
PQPFLPQLPYPQP

SEQ ID NO: 1897 - protein, 12 aa, Artificial Sequence
  Description of Artificial Sequence: Synthetic gluten peptide
QPFPQPQQPQQP

SEQ ID NO: 1898 - protein, 15 aa, Artificial Sequence
  Description of Artificial Sequence: Synthetic gluten peptide
SGQGVSQSQQQSQQQ

SEQ ID NO: 1899 - protein, 16 aa, Artificial Sequence
  Description of Artificial Sequence: Synthetic gluten peptide
QYEVIRSLVLRTLPNM

SEQ ID NO: 1900 - protein, 16 aa, Artificial Sequence
  Description of Artificial Sequence: Synthetic gluten peptide
GLARSQMLQQSICHVG

SEQ ID NO: 1901 - protein, 16 aa, Artificial Sequence
  Description of Artificial Sequence: Synthetic gluten peptide
RTTTSVPFGVGTGVGA

SEQ ID NO: 1902 - protein, 16 aa, Artificial Sequence
  Description of Artificial Sequence: Synthetic gluten peptide
AIHTVIHSIIMQQEQQ

SEQ ID NO: 1903 - protein, 17 aa, Artificial Sequence
  Description of Artificial Sequence: Synthetic gluten peptide
QLQPFPQPELPYPQPQL

SEQ ID NO: 1904 - protein, 17 aa, Artificial Sequence
  Description of Artificial Sequence: Synthetic gluten peptide
QPEQPFPQPEQPFPWQP

SEQ ID NO: 1905 - protein, 35 aa, Artificial Sequence
  Description of Artificial Sequence: Synthetic gluten peptide
QLQPFPQPELPYPQPFPQQPEQPFPQPEQPFPWQP

SEQ ID NO: 1906 - protein, 9 aa, Artificial Sequence
  Description of Artificial Sequence: Synthetic gluten peptide
QGSFQPSQQ

SEQ ID NO: 1907 - protein, 16 aa, Artificial Sequence
  Description of Artificial Sequence: Synthetic gluten peptide
VYIPPYCTIAPFGIFG

SEQ ID NO: 1908 - protein, 16 aa, Artificial Sequence
  Description of Artificial Sequence: Synthetic gluten peptide
AMCNVYIPPYCAMAPF

SEQ ID NO: 1909 - protein, 9 aa, Artificial Sequence
  Description of Artificial Sequence: Synthetic gluten peptide
ZQPTPIQPZ

SEQ ID NO: 1910 - protein, 9 aa, Artificial Sequence
  Description of Artificial Sequence: Synthetic gluten peptide
ZQPFPLQPZ

SEQ ID NO: 1911 - protein, 9 aa, Artificial Sequence
  Description of Artificial Sequence: Synthetic gluten peptide
ZQPIPVQPZ

SEQ ID NO: 1912 - protein, 9 aa, Artificial Sequence
  Description of Artificial Sequence: Synthetic gluten peptide
ZQPQQPFPZ

SEQ ID NO: 1913 - protein, 9 aa, Artificial Sequence
  Description of Artificial Sequence: Synthetic gluten peptide
ZQPZLPFPZ

SEQ ID NO: 1914 - protein, 9 aa, Artificial Sequence
  Description of Artificial Sequence: Synthetic gluten peptide
ZGSFQPSQZ

SEQ ID NO: 1915 - protein, 9 aa, Artificial Sequence
  Description of Artificial Sequence: Synthetic gluten peptide
ZLPFPZQPZ

SEQ ID NO: 1916 - protein, 9 aa, Artificial Sequence
  Description of Artificial Sequence: Synthetic gluten peptide
ZQPFPZQPZ

SEQ ID NO: 1917 - protein, 12 aa, Artificial Sequence
  Description of Artificial Sequence: Synthetic gluten peptide
PQQQQQQLVQQQ

SEQ ID NO: 1918 - protein, 15 aa, Artificial Sequence
  Description of Artificial Sequence: Synthetic gluten peptide
  MOD_RES (9)..(9): L or Q
  MOD_RES (11)..(11): A or S
QGIFLQPHXIXQLEV

SEQ ID NO: 1919 - protein, 10 aa, Artificial Sequence
  Description of Artificial Sequence: Synthetic gluten peptide
  MOD_RES (9)..(9): H or Y
QPGQGQQGXY

SEQ ID NO: 1920 - protein, 13 aa, Artificial Sequence
  Description of Artificial Sequence: Synthetic gluten peptide
  MOD_RES (12)..(12): F or Y
QSRYEAIRAIIXS

SEQ ID NO: 1921 - protein, 9 aa, Artificial Sequence
  Description of Artificial Sequence: Synthetic gluten peptide
RTTTSVPFD

SEQ ID NO: 1922 - protein, 9 aa, Artificial Sequence
  Description of Artificial Sequence: Synthetic gluten peptide
QPPFWRQQP

SEQ ID NO: 1923 - protein, 9 aa, Artificial Sequence
  Description of Artificial Sequence: Synthetic gluten peptide
  MOD_RES (2)..(3): P or S
  MOD_RES (4)..(4): F or I
  MOD_RES (5)..(5): P or S
QXXXXQQQQ

SEQ ID NO: 1924 - protein, 9 aa, Artificial Sequence
  Description of Artificial Sequence: Synthetic gluten peptide
  MOD_RES (1)..(1): Q or P or L or R
XGYYPTSPQ

SEQ ID NO: 1925 - protein, 12 aa, Artificial Sequence
  Description of Artificial Sequence: Synthetic gluten peptide
QGSYYPGQASPQ

SEQ ID NO: 1926 - protein, 20 aa, Artificial Sequence
  Description of Artificial Sequence: Synthetic gluten peptide
GYYPTSSLQPEQGQQGYYPT

SEQ ID NO: 1927 - protein, 20 aa, Artificial Sequence
  Description of Artificial Sequence: Synthetic gluten peptide
QGQQLAQGQQGQQPAQVQQG

SEQ ID NO: 1928 - protein, 266 aa, Artificial Sequence
  Description of Artificial Sequence: Synthetic A-gliadin
VRVPVPQLQPQNPSQQQPQEQVPLVQQQQFPGQQQQFPPQQPYPQPQPFPSQQPYLQLQPFPQPQLPYPQPQSFPPQQPYPQPQPQYSQPQQPISQQQAQQQQQQQQQQQQQQILQQILQQQLIPCMDVVLQQHNIAHARSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIAPYCTIAPFGIFGTN

SEQ ID NO: 1929 - protein, 4 aa, Artificial Sequence
  Description of Artificial Sequence: Synthetic gluten peptide
  MOD_RES (2)..(2): Any amino acid
  MOD_RES (4)..(4): Any amino acid
QXPX

SEQ ID NO: 1930 - protein, 10 aa, Artificial Sequence
  Description of Artificial Sequence: Synthetic gluten peptide
  MOD_RES (2)..(2): Any amino acid
  MOD_RES (3)..(3): Any amino acid
QXXFYMILVW

SEQ ID NO: 1931 - protein, 20 aa, Artificial Sequence
  Description of Artificial Sequence: Synthetic marker peptide
VLQQHNIAHGSSQVLQESTY

SEQ ID NO: 1932 - protein, 20 aa, Artificial Sequence
  Description of Artificial Sequence: Synthetic marker peptide
IKDFHVYFRESRDALWKGPG

SEQ ID NO: 1933 - protein, 20 aa, Artificial Sequence
  Description of Artificial Sequence: Synthetic gliadin peptide
PQPFPPQLPYPQPQLPYPQP

SEQ ID NO: 1934 - protein, 10 aa, Artificial Sequence
  Description of Artificial Sequence: Synthetic gluten peptide
  MOD_RES (2)..(2): Any amino acid
  MOD_RES (3)..(3): Any amino acid
QXXFYWILVM

SEQ ID NO: 1935 - protein, 7 aa, Artificial Sequence
  Description of Artificial Sequence: Synthetic gluten peptide
FYWILVM

SEQ ID NO: 1936 - protein, 16 aa, Artificial Sequence
  Description of Artificial Sequence: Synthetic gluten peptide
  MOD_RES (2)..(8): Any amino acid
  MOD_RES (10)..(15): Any amino acid
QXXXXXXXQXXXXXXG

SEQ ID NO: 1937 - protein, 7 aa, Artificial Sequence
  Description of Artificial Sequence: Synthetic gliadin peptide
PQPQLPY

SEQ ID NO: 1938 - protein, 5 aa, Artificial Sequence
  Description of Artificial Sequence: Synthetic gliadin peptide
PQLPY

SEQ ID NO: 1939 - protein, 8 aa, Artificial Sequence
  Description of Artificial Sequence: Synthetic gliadin peptide
PQPQQPFP

SEQ ID NO: 1940 - protein, 9 aa, Artificial Sequence
  Description of Artificial Sequence: Synthetic gliadin peptide
PFPQQPQQP

SEQ ID NO: 1941 - protein, 11 aa, Artificial Sequence
  Description of Artificial Sequence: Synthetic deamidated gluten peptide
EQPIPEQPQPY

SEQ ID NO: 1942 - protein, 4 aa, Artificial Sequence
  Description of Artificial Sequence: Synthetic gluten peptide
  MOD_RES (2)..(3): Any amino acid
  MOD_RES (4)..(4): F or Y or M or I or L or V or W
QXXX

SEQ ID NO: 1943 - protein, 5 aa, Artificial Sequence
  Description of Artificial Sequence: Synthetic gluten peptide
  MOD_RES (2)..(2): Any amino acid
QXPFY

SEQ ID NO: 1944 - protein, 4 aa, Artificial Sequence
  Description of Artificial Sequence: Synthetic gluten peptide
  MOD_RES (2)..(2): Any amino acid
QXPF

SEQ ID NO: 1945 - protein, 4 aa, Artificial Sequence
  Description of Artificial Sequence: Synthetic gluten peptide
  MOD_RES (2)..(3): Any amino acid
  MOD_RES (4)..(4): F or Y
QXXX

SEQ ID NO: 1946 - protein, 6 aa, Artificial Sequence
  Description of Artificial Sequence: Synthetic gluten peptide
  MOD_RES (3)..(3): Q or L
  MOD_RES (5)..(5): F or Y
PQXPXP

SEQ ID NO: 1947 - protein, 4 aa, Artificial Sequence
  Description of Artificial Sequence: Synthetic gluten peptide
  MOD_RES (2)..(2): Any amino acid
  MOD_RES (4)..(4): F or Y or W or I or L or V or W
QXZX

SEQ ID NO: 1948 - protein, 16 aa, Artificial Sequence
  Description of Artificial Sequence: Synthetic gluten peptide
SEQYQPYPEQQEPFVQ

We claim:

1. A method of treating coeliac disease comprising administering to an individual in need thereof a therapeutically effective amount of a peptide, wherein the peptide:
   comprises an amino acid sequence representing a glutamine-deamidated counterpart of SEQ ID NO: 1787, wherein the glutamine-deamidated counterpart of SEQ ID NO: 1787 is Glu Gln Pro Ile Pro Glu Gln Pro Gln Pro Tyr (SEQ ID NO: 1941);
   is 15 to 20 amino acid residues in length.
2. The method of claim 1, further comprising administering a pharmaceutically acceptable carrier or diluent.
3. The method according to claim 1, wherein the peptide is 15 amino acid residues in length.
4. The method according to claim 1, wherein the peptide is 16 amino acid residues in length.
5. The method according to claim 1, wherein the peptide is 17 amino acid residues in length.
6. The method according to claim 1, wherein the peptide is 18 amino acid residues in length.
7. The method according to claim 1, wherein the peptide is 19 amino acid residues in length.
8. The method according to claim 1, wherein the peptide is 20 amino acid residues in length.
9. The method according to any one of claims 1, 2, and 3-8, wherein the peptide is administered to the individual intradermally or subcutaneously.

* * * * *